United States Patent 7,745,391 (HUMAN THROMBOSPONDIN POLYPEPTIDE) - sequence listing, part 156

SEQ ID NO: 406453 - DNA, 2267 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaactattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406454 - DNA, 2418 bp, Homo sapiens
  misc_feature (1869)..(1869): n is a, c, g, or t
  misc_feature (1886)..(1886): n is a, c, g, or t
  misc_feature (1889)..(1889): n is a, c, g, or t
  misc_feature (1902)..(1902): n is a, c, g, or t
  misc_feature (1926)..(1926): n is a, c, g, or t
  misc_feature (1933)..(1933): n is a, c, g, or t
  misc_feature (1944)..(1944): n is a, c, g, or t
  misc_feature (1964)..(1964): n is a, c, g, or t
  misc_feature (1970)..(1970): n is a, c, g, or t
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccaaaaaaaaaaaaaaaaaaaaaaaaaaacccnacaaaaaaaaaaaaaangcnaaaaccaaaaaanaaaaaaaaaaattggacaaagccnaaaaaanaaaaaaaaaanaaaccacaacaaaaaaacanaaagangtataacagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406455 - DNA, 2219 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccaaaaaaaaaaaaaaaaaaaaaaaaaaaaactttgttgggccccccgggcccccgcgaaaaactttttaaaaccttgctgccgttgtggggcccgcgggccccatgtgggtgttaggtgtgaacatgtgtggtccaatcctgtgtttcccctaaggaaaatccctgggctcatagaactagggtggtgtgggatttcttcacccgcatattataaaaaacccccccggggggaacaacccggaggatgtttctgagaacaaattcctcgaaagagtggcgctttcgaggaggggcccacataccggggggaccttttattcacagcgggagtccacaacgcgagcagcctccgagattcttaaattttacccccccgactat

SEQ ID NO: 406456 - DNA, 2331 bp, Homo sapiens
  misc_feature (1666)..(1667): n is a, c, g, or t
  misc_feature (1670)..(1670): n is a, c, g, or t
  misc_feature (1683)..(1683): n is a, c, g, or t
  misc_feature (1695)..(1695): n is a, c, g, or t
  misc_feature (1749)..(1749): n is a, c, g, or t
  misc_feature (1782)..(1782): n is a, c, g, or t
  misc_feature (1799)..(1799): n is a, c, g, or t
  misc_feature (1802)..(1802): n is a, c, g, or t
  misc_feature (1815)..(1815): n is a, c, g, or t
  misc_feature (1839)..(1839): n is a, c, g, or t
  misc_feature (1846)..(1846): n is a, c, g, or t
  misc_feature (1857)..(1857): n is a, c, g, or t
  misc_feature (1877)..(1877): n is a, c, g, or t
  misc_feature (1883)..(1883): n is a, c, g, or t
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgaaacataannaancacataaaaatanaaaaaaaacctnaccacccaaacaactctcccaccaacaacaacaaaaaaaaacaaagaaacaaanacaaaaaaaaaaaaaaaaaaaaaaaaaaacccnacaaaaaaaaaaaaaangcnaaaaccaaaaaanaaaaaaaaaaattggacaaagccnaaaaaanaaaaaaaaaanaaaccacaacaaaaaaacanaaagangtataacagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406457 - DNA, 2445 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgaggtgagtgcccgggagggaagctgtgcgggcagcagtcctggtttactctcttgagcctgtgcatctctgcacctggagtcaagtccttcccatcagacctcagccctggtgcacccgcgggccttttaagaggttcttctctgaagacccttcatcttccttatcacaagtttaagtgctgcatggcatttgatactcttgacagccaagatacatttcagtagtaaggttgctttcctgattattaccttaaagtgaacatttaacctggaattcatttactttatcttagaaaaatagaaaatgatagctttgaaattagcacttatttctgtactgttgtgtcccaccctcctcaaaaggacacgttcaagtggcttccagtgttaaaatggtgagtgatgtgatgttgaaatgtttcacctgagttctgagcttttccatccgtataatcataggtacgaaggtcagggtaggagtcagactgaggagaacctggattgtagcaggagtagctccagagagtcgctcttccgtaaaatgagatgttgaccttccagggtgtccccttctgcagatctaacagtggctttctgtcgtctcccagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgcc

SEQ ID NO: 406458 - DNA, 1460 bp, Homo sapiens
  misc_feature (11)..(11): n is a, c, g, or t
ccattttaacnctggaagccactgaacgtgtccttttgaggagggtgggacacaacagtacagaaataagtgctgcatggcatttgatactcttgacagccaagatacatttcagtagtaaggttgctttcctgattattaccttaaagtgaacatttaacctggaattcatttactttatcttagaaaaatagaaaatgatagctttgaaattagcacttatttctgtactgttgtgtcccaccctcctcaaaaggacacgttcaagtggcttccagtgttaaaatggtgagtgatgtgatgttgaaatgtttcacctgagttctgagcttttccatccgtataatcataggtacgaaggtcagggtaggagtcagactgaggagaacctggattgtagcaggagtagctccagagagtcgctcttccgtaaaatgagatgttgaccttccagggtgtccccttctgcagatctaacagtggctttctgtcgtctcccagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406459 - DNA, 1415 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgatacagagtcttggcaccgcccccgattacgacttcccctcgagtataacctcaccccagtcatacgcattccct

SEQ ID NO: 406460 - DNA, 1128 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagtgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406461 - DNA, 1913 bp, Homo sapiens
  misc_feature (1248)..(1249): n is a, c, g, or t
  misc_feature (1252)..(1252): n is a, c, g, or t
  misc_feature (1265)..(1265): n is a, c, g, or t
  misc_feature (1277)..(1277): n is a, c, g, or t
  misc_feature (1331)..(1331): n is a, c, g, or t
  misc_feature (1364)..(1364): n is a, c, g, or t
  misc_feature (1381)..(1381): n is a, c, g, or t
  misc_feature (1384)..(1384): n is a, c, g, or t
  misc_feature (1397)..(1397): n is a, c, g, or t
  misc_feature (1421)..(1421): n is a, c, g, or t
  misc_feature (1428)..(1428): n is a, c, g, or t
  misc_feature (1439)..(1439): n is a, c, g, or t
  misc_feature (1459)..(1459): n is a, c, g, or t
  misc_feature (1465)..(1465): n is a, c, g, or t
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgaaacataannaancacataaaaatanaaaaaaaacctnaccacccaaacaactctcccaccaacaacaacaaaaaaaaacaaagaaacaaanacaaaaaaaaaaaaaaaaaaaaaaaaaaacccnacaaaaaaaaaaaaaangcnaaaaccaaaaaanaaaaaaaaaaattggacaaagccnaaaaaanaaaaaaaaaanaaaccacaacaaaaaaacanaaagangtataacagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406462 - DNA, 1375 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactgaccccaccagctttgacaaccagccacggcaggagcatttacaccacggccatccacaaatgctacaggccagcacacggctgctgatgggagaatctcaagagtcaacagatgaagaaaatgggtgctccatagaatgccaacagctttagtctaaatatacacatttttatacatggaagaatccattgtcaacttttaaacattggttaccttttgggagaataaagggaatgggggcgatgatcacagctcggatgatattattattttaaagataaaatcataaaataattttaaagataaaataaatataattaaaatgataaaat

SEQ ID NO: 406463 - DNA, 350 bp, Homo sapiens
tctgtcagagatacacgtgtcagaactgtgtcacacctggtgaagccgacagtgaggtaaagacacagtcttgggccgggccagatgaggcacttgctgaaggccgggctgaggaccgcctaccttccgtctcctgtaggtggcagaactggtgaagccattgtagatgctgcgctgagtgctctgcgccagctcgtgaaggatcgcctcgggggacggagcggaggatacagttctggaaaacaagtaagaccataaaatgtcagtttttaatgtgtcataattttgaagccagagtggataccttgtataagatagttgttttttaacagtatgttaaagtggtgaac

SEQ ID NO: 406464 - DNA, 634 bp, Homo sapiens
  misc_feature (102)..(102): n is a, c, g, or t
gctggagggcagctcaggctgacccccaatcgttgcttccaggggtacccgacatggcctggccctctcaaatgcccatgtctcctggctcggctgtgcatnctccctctcatgggttggcaggggcagggaggtgcagtggacagaaacaagacaggcctgggctcaagccacgccctcctgctttctggccgactggcttcaggtttccccatttgttccacagcggggataatgccagtgctgagagccgactgtgccaggctccttcacattccctcctcgcagccccacgtggtgacaccccaccagctttgacaaccagccacggcaggagcatttacaccacggccatccacaaatgctacaggccagcacacggctgctgatgggagaatctcaagagtcaacagatgaagaaaatgggtgctccatagaatgccaacagctttagtctaaatatacacatttttatacatggaagaatccattgtcaacttttaaacattggttaccttttgggagaataaagggaatgggggcgatgatcacagctcggatgatattattattttaaagataaaatcataaaataattttaaagataaaataaatataattaaaatgataaaat

SEQ ID NO: 406465 - DNA, 480 bp, Homo sapiens
acaggaagacagctggcccagtgaccctcagaagtggattgcagaagtgggggtacctcccaggttccacagcggggataatgccagtgctgagagccgactgtgccaggctccttcacattccctcctcgcagccccacgtggtgacaccccaccagctttgacaaccagccacggcaggagcatttacaccacggccatccacaaatgctacaggccagcacacggctgctgatgggagaatctcaagagtcaacagatgaagaaaatgggtgctccatagaatgccaacagctttagtctaaatatacacatttttatacatggaagaatccattgtcaacttttaaacattggttaccttttgggagaataaagggaatgggggcgatgatcacagctcggatgatattattattttaaagataaaatcataaaataattttaaagataaaataaatataattaaaatgataaaat

SEQ ID NO: 406466 - DNA, 2331 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406467 - DNA, 2104 bp, Homo sapiens
aattgagaatcaaaggctttaatggttgctttgtgttgtcttcccccaaaaggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406468 - DNA, 2244 bp, Homo sapiens
gataaatgacagttactctcagccctgccaattctgtgagctgcagagttccctccatgggctttgatttcccccatcattccatttagattctcttctggtgttcaaggctaaagcccttattgactgattgcaaactgcaccctgtgctttattacctttttctgagtctatgtgaagcagataatgagttcttgtggagtctgctttagcggaaggaaaaattgttatttcttttacatttccacaggatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406469 - DNA, 1827 bp, Homo sapiens
ctgtgctgaggtgacctgatttcccaatgcacgacaaggagcggaggatacagttctgggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406470 - DNA, 2287 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406471 - DNA, 2938 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgaggtgagtgcccgggagggaagctgtgcgggcagcagtcctggtttactctcttgagcctgtgcatctctgcacctggagtcaagtccttcccatcagacctcagccctggtgcacccgcgggccttttaagaggttcttctctgaagacccttcatcttccttatcacaagtttaagtgctgcatggcatttgatactcttgacagccaagatacatttcagtagtaaggttgctttcctgattattaccttaaagtgaacatttaacctggaattcatttactttatcttagaaaaatagaaaatgatagctttgaaattagcacttatttctgtactgttgtgtcccaccctcctcaaaaggacacgttcaagtggcttccagtgttaaaatggtgagtgatgtgatgttgaaatgtttcacctgagttctgagcttttccatccgtataatcataggtacgaaggtcagggtaggagtcagactgaggagaacctggattgtagcaggagtagctccagagagtcgctcttccgtaaaatgagatgttgaccttccagggtgtccccttctgcagatctaacagtggctttctgtcgtctcccagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406472 - DNA, 1965 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggcttttccttacggataacatttggtcatgcataaacaaacaccgcaaccaaaacaacacaccacaaaaaacaacaaatagacaccggggggggcacaccgttagtataagagggccaaacgaggaagtccccaaaggaccaccagtagaaacccccctgatttgc

SEQ ID NO: 406473 - DNA, 1189 bp, Homo sapiens
actgatatggggaggtggtctggggaggtctgtgtggtctgccccttgaggaggtggaggtggtccctggggctttccagcgggaggtggcagaggctgctggggatgcctcctggtgggggtggtccttgtggccttccgtggaggaactcgttgatgccttgctcactgaaggagccttttagcagagcaaatttcatcttgcgtgcattgatggcggccatggcgggcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406474 - DNA, 1374 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcaggtaatttgttttcttaggttgtttgttgttttgtctgtttgtttggttctgttgtaggtttatatttggaactaggtatatataagccaggtaataaat

SEQ ID NO: 406475 - DNA, 1505 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtggggtttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaa

SEQ ID NO: 406476 - DNA, 894 bp, Homo sapiens
cccctcggaccaccggactggcctggggcgggacgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtaaggacttttcctagctacttcattcccctggtagacaagaacctactgttctttaacaagcttgagaacctgctctacctgcaaggttctcaacctcattgtacctgaattatctataaatggtacacagtgattcctataccctccgagtcattctgaagatgaaatatgtgtcacacaggtttgtctcatcacttaacgcttgcttaggtctatgctacattggcaatgatagaaaatagtgttctgtgctaccctgttgtctttctcattacagtcacttgtatttaataaagatctacatgtattttcttgctctaatctctcttccctttactgtaggaaaagggtctaacataacactatggaaaaggagactgtaatttgagagtcttagtctcctaaactgtcaataataaatggatac

SEQ ID NO: 406477 - DNA, 1870 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406478 - DNA, 323 bp, Homo sapiens
ctccctccatttcactccctcatgatctacctacaccactcccccctccactcgaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406479 - DNA, 729 bp, Homo sapiens
cgtcacgagacggtcttacgatttgacactacgaacgactactgtcacatcgtggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataataaggtccctgagtagttcatttatgtattcatttgctcactcattctttcaacaccgattttattgagcaccttaaaaaaaacaatcacgtctagcactactactacaagaccgcgtctatccaaaaaaaataaaactcggaggggggcccgggcccaaatccccataaggaggggatttacaaaaaacggccgtcgtttaccaactcgggacggggaaaaccctgggcttacccaaattaaaacgccttggggaataatcccctttcgccagggtgcgaaataaccc

SEQ ID NO: 406480 - DNA, 368 bp, Homo sapiens
tcgtgccgctcgtgccgaattcggcacgaggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataaaaaaaaaggcttacgaaaagatgtaattaaaaaaacctcgagggggggcccggtgcccaattcgccct

SEQ ID NO: 406481 - DNA, 1760 bp, Homo sapiens
  misc_feature (24)..(24): n is a, c, g, or t
  misc_feature (33)..(33): n is a, c, g, or t
aagtgcatgtgataacctgccctnctcggttantttctcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406482 - DNA, 1827 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaagtgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406483 - DNA, 1694 bp, Homo sapiens
  misc_feature (2)..(3): n is a, c, g, or t
  misc_feature (16)..(16): n is a, c, g, or t
  misc_feature (20)..(20): n is a, c, g, or t
  misc_feature (28)..(28): n is a, c, g, or t
anncgagacctttatngaanactcccanacacagactcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406484 - DNA, 2211 bp, Homo sapiens
  misc_feature (1888)..(1892): n is a, c, g, or t
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataaaaaaaaaaaaaaaaaaannnnnaaaaaaaaaaaaaaaaaaaaaaaaacccttgtgggccggctcggcccaattcgaatttatgacttggagaagcttatgcatgcggccccaatttgagcctaactgggcaattcgccataaagagaggggatttaaaaaaattgggcggcggttataaccgcggagtggggaaaacacgggggttaccaattaaaaggcttggagaaaacccctttttacagggggggaaaacaaaaaggccccccactgcgcctccaaaatttgcccccctatgggaaggaatttacgcccaatttttttaaaaacgcgcaatttgtta

SEQ ID NO: 406485 - DNA, 2213 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataaaacacagattcctcagatccagaagactgaaatatcctttcgacctaatgatcccaagagctatgaggcatatgtactgaacatagttaggttcctggatgtgcccagtgaaccgaaagaacgaggagactttaatcatgaacgatgagagttaagggctgcagattaaacttgaatggctggaaattgtctggataaatgatgaacttatggtacaaagaggcaaccgtgcatatataaagcttaccgagtttaggtttaaactaagcctccagaatgattctcgaaacttaccagtgagaatttacccaaatgcccttccgttatgcaatgccagcggata

SEQ ID NO: 406486 - DNA, 1990 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataaaactaaaaaagaaaaaatttcactgcccgtcgcttaaacaacgttggactgggaaacccttggcgtacccaacttaatggctttgaggacatccccctttcccagctgccgaataacgat

SEQ ID NO: 406487 - DNA, 2027 bp, Homo sapiens
  misc_feature (1932)..(1932): n is a, c, g, or t
  misc_feature (1934)..(1934): n is a, c, g, or t
  misc_feature (1936)..(1936): n is a, c, g, or t
  misc_feature (1942)..(1942): n is a, c, g, or t
  misc_feature (1944)..(1944): n is a, c, g, or t
  misc_feature (1947)..(1947): n is a, c, g, or t
  misc_feature (1952)..(1952): n is a, c, g, or t
  misc_feature (1963)..(1964): n is a, c, g, or t
  misc_feature (1967)..(1967): n is a, c, g, or t
  misc_feature (1979)..(1979): n is a, c, g, or t
  misc_feature (1982)..(1982): n is a, c, g, or t
  misc_feature (1987)..(1987): n is a, c, g, or t
  misc_feature (1992)..(1993): n is a, c, g, or t
  misc_feature (2000)..(2000): n is a, c, g, or t
  misc_feature (2004)..(2004): n is a, c, g, or t
  misc_feature (2011)..(2011): n is a, c, g, or t
  misc_feature (2013)..(2013): n is a, c, g, or t
  misc_feature (2015)..(2015): n is a, c, g, or t
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataaaaaaaaaaaaaaaaaaaaaaaaactcggggggggccccggacccaacttgcctatagtgagncnantacaantnatngccgncgtttaaacgnngantggaaaccctgngtncccantaatnncttgganaatnccctttncnantgggataaaaca

SEQ ID NO: 406488 - DNA, 846 bp, Homo sapiens
gagacatgtggtctgggatgaaaggctgggagctccatgttccaaccagctgcagcacgcacataacatgcgctgcagctccaaacgcacacccacatacactgccagacaccaaagtccacagacacaggtgttcagacagaagcgcctgttaggagggaagggatggagaagggctggatttaggtttgatctggcagaagctgaggaaatgagggggcatgaggctgagcaaggaagggagtacgaagtcccagacccacttttcctcttccactctggagcagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406489 - DNA, 1815 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaactgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406490 - DNA, 1813 bp, Homo sapiens
  misc_feature (1650)..(1651): n is a, c, g, or t
  misc_feature (1663)..(1663): n is a, c, g, or t
  misc_feature (1672)..(1672): n is a, c, g, or t
  misc_feature (1681)..(1682): n is a, c, g, or t
  misc_feature (1686)..(1686): n is a, c, g, or t
  misc_feature (1690)..(1690): n is a, c, g, or t
  misc_feature (1696)..(1697): n is a, c, g, or t
  misc_feature (1704)..(1704): n is a, c, g, or t
  misc_feature (1707)..(1707): n is a, c, g, or t
  misc_feature (1718)..(1718): n is a, c, g, or t
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaaccnnaaggctgtactnacaccctgntcacctatnntggncccnacacannttagagntcnaacccccaccnttttccgcaatctcttcctattttcaacccaatcttcctttctttttaacttcgtggaatggcaacgatgggcataaaccagttcttttttttta

SEQ ID NO: 406491 - DNA, 1628 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggccccccgagatctttctataatgcccgctgtggaaaggtcaaccccagggccaaataagggcacctgcctccttgaagcatccaaagggggtttttaacactcttaaaaaaaaa

SEQ ID NO: 406492 - DNA, 1636 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406493 - DNA, 1145 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacccttctccgccattcttccctactcccaacccactctgccttctttttcagcttgtggcaatgccagtgatgtgcataaacagtttttttttttccataa

SEQ ID NO: 406494 - DNA, 870 bp, Homo sapiens
  misc_feature (2)..(3): n is a, c, g, or t
  misc_feature (16)..(16): n is a, c, g, or t
  misc_feature (20)..(20): n is a, c, g, or t
  misc_feature (28)..(28): n is a, c, g, or t
anncgagacctttatngaanactcccanacacagactcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagactttccccaacataaccctgcaaacattaaagagccatgttccacaaccatctggtggggaagcacacacacttcccggcaggttcaattttgcacttttccctggctggatccaagagc

SEQ ID NO: 406495 - DNA, 452 bp, Homo sapiens
  misc_feature (2)..(3): n is a, c, g, or t
  misc_feature (16)..(16): n is a, c, g, or t
  misc_feature (20)..(20): n is a, c, g, or t
  misc_feature (28)..(28): n is a, c, g, or t
anncgagacctttatngaanactcccanacacagactcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccgaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406496 - DNA, 446 bp, Homo sapiens
taaggtccctgagtagttcatttatgtattcatttgctcactcattctttcaacaccgattttattgagcacctactatgtgccattcactttctcaggacactcgagctccgtggtctctgaagcttacattctagtgagggctaacaagtgaataagttcagagactcgtaagtgctttgaagtcaatcacaatttgtgtgatgtgatgagaaaatggcagaggcagtgggtggctgctttgaacaaggggtcaggaaaagtgttgcatgctgagaagcaggtaaaaaggcctccaggtgggagaggtcagcatggccagtgaaggggagagtgggccctgatgaggtcagagtggacatagtggtccgttcccactgtagctgggattacaggaggccaggagggaggttgggttttattctaattatgacaggaagtcactg

SEQ ID NO: 406497 - DNA, 529 bp, Homo sapiens
cataggttgaaaagggctggcccttcagatctgggggtgtggtgagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406498 - DNA, 1781 bp, Homo sapiens
  misc_feature (2)..(3): n is a, c, g, or t
  misc_feature (16)..(16): n is a, c, g, or t
  misc_feature (20)..(20): n is a, c, g, or t
  misc_feature (28)..(28): n is a, c, g, or t
anncgagacctttatngaanactcccanacacagactcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406499 - DNA, 1727 bp, Homo sapiens
  misc_feature (2)..(3): n is a, c, g, or t
  misc_feature (16)..(16): n is a, c, g, or t
  misc_feature (20)..(20): n is a, c, g, or t
  misc_feature (28)..(28): n is a, c, g, or t
anncgagacctttatngaanactcccanacacagactcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaacggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406500 - DNA, 1640 bp, Homo sapiens
  misc_feature (2)..(3): n is a, c, g, or t
  misc_feature (16)..(16): n is a, c, g, or t
  misc_feature (20)..(20): n is a, c, g, or t
  misc_feature (28)..(28): n is a, c, g, or t
anncgagacctttatngaanactcccanacacagactcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaacggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406501 - DNA, 2109 bp, Homo sapiens
  misc_feature (1888)..(1892): n is a, c, g, or t
  misc_feature (2085)..(2085): n is a, c, g, or t
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataaaaaaaaaaaaaaaaaaannnnnaaaaaaaaaaaaaaaaaaaaaaaaaaaaaaaaaaatataaaaataaatatattataaatatataaaatatatttaaaatttaatttaaaaaaaaatatataaaaaaattatttttcttatttacattttaatttaatttcaatttaattttttttattaattcttttaatatataccataataacccttctcntcctcttataacactctctcccca

SEQ ID NO: 406502 - DNA, 2032 bp, Homo sapiens
  misc_feature (1937)..(1937): n is a, c, g, or t
  misc_feature (1939)..(1939): n is a, c, g, or t
  misc_feature (1941)..(1941): n is a, c, g, or t
  misc_feature (1947)..(1947): n is a, c, g, or t
  misc_feature (1949)..(1949): n is a, c, g, or t
  misc_feature (1952)..(1952): n is a, c, g, or t
  misc_feature (1957)..(1957): n is a, c, g, or t
  misc_feature (1968)..(1969): n is a, c, g, or t
  misc_feature (1972)..(1972): n is a, c, g, or t
  misc_feature (1984)..(1984): n is a, c, g, or t
  misc_feature (1987)..(1987): n is a, c, g, or t
  misc_feature (1992)..(1992): n is a, c, g, or t
  misc_feature (1997)..(1998): n is a, c, g, or t
  misc_feature (2005)..(2005): n is a, c, g, or t
  misc_feature (2009)..(2009): n is a, c, g, or t
  misc_feature (2016)..(2016): n is a, c, g, or t
  misc_feature (2018)..(2018): n is a, c, g, or t
  misc_feature (2020)..(2020): n is a, c, g, or t
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataatcaaaaaaaaaaacaagctatgcttgcggccccattcgagctcattggccaatcgcctatagtgagncnantacaantnatngccgncgtttaaacgnngantggaaaccctgngtncccantaatnncttgganaatnccctttncnantgggataaaaca

SEQ ID NO: 406503 - DNA, 1824 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggatttagagatacaaccccccacccttctccgccattcttccctactcccaacccactctgccttctttttcagcttgtggcaatgccagtgatgtgcataaacagtttttttttttccataa

SEQ ID NO: 406504 - DNA, 596 bp, Homo sapiens
cctgggctgtaggaattcggcactaggttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 406505 - DNA, 1783 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagaaaaacaaaaaaaaaaaagaaaaaaaaaaaaaaaaaaaaaaaaaaaaaaaaaaaaaaaaaaaaaaaaaaaaaaaaaaaaaaaaaaaaaaaggggggggggggaaaaaaagggggggccgaccaaataatcacgaccgcaccacaacatagtcttgggagaaaaagggggcgcgcccaaatataagggcgcgcgcgtataataataatacacagcaaccgagcggagcgcggcccgcgctattatcaaaaacaccgcgtgcgctagccagcggaaaaaaccgagcggaactccggcgggcacccatcgctaggagaaaagaacaccaccaaatgcgggggggggagggcaaaacaactgggcgggcaacacacctccccgagagataattttaacggccgacggcgggacaatacaaacaaccttgcagcgcgactaatggtggggtgcaaccacccgacgatatgatgcccctgcgcgagcagaaaaatgctcgccacaacagattacactagaaaaaaatataacagcg

SEQ ID NO: 406506 - DNA, 561 bp, Homo sapiens
gagaatcgcttaaacccaggaggcagaggttgcagtgagccgagatcacgccattgccctctagcttgggcaacagagcgagactgtctcaccaaaaaaaaaaaaaatcattatccctgatgttcttgtctcatgctaggaatgtaatcttgcctttatagtctttattctttaagatccttatagaccaaaaaaaacgttatcaccagcatctagcataggaagtgacatatagtagtacctgctgcgcaaacactgattgaataagatgttttgtccttccttaacggcatgatctaagttgttttctttgctttccacagctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacaga

SEQ ID NO: 406507 - DNA, 3508 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406508 - DNA, 1176 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgagacccgcgagggggagcctctagagcagattacagcgg

SEQ ID NO: 406509 - DNA, 2440 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406510 - DNA, 3454 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406511 - DNA, 1593 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaggttttgccatgttacccaggctggtctcagactcttggtcccccaaagggctaggattccaggtgtgagccactgtgcctggtccaagtaacagttcttaaaagaaacaacagagaaaacacaggggaggaaatcatcagtgaagtcgttcaagaaaaaaattccctgtaaagaagcatagtaagaagtttccagattgaaaggacccacttgacttcccagtacaataacatcgacatgaaagtgactaactacaagcttccagaggaggaagacaggtcacatggcaaaaagatcaagaataagaatagctttggacttctcaacagcagcaccagccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacaga

SEQ ID NO: 406512 - DNA, 910 bp, Homo sapiens
cggaagaggacgaaataactagctggaggcagcagtgtcagccgatgccggtgccacggctcgaaacaccggcgccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacaga

SEQ ID NO: 406513 - DNA, 3564 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtaggagtgcaaacctattccaaccctttagaaaggaagttagcacttgtgatcgggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406514 - DNA, 1890 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatggtaagcattctccagaccgccacccagtttctccagttctccccgtccccatcccagcaaactgggtactaaatataactccatttctttatcttttttgtatcactaaagtcaaatgcctagcaacttgtaaaactgcaggtgaccactactaattttcctttctgggtggcacagagtttgaaaataagagcaaagcattctgggtcaagtgcaaacttttggtagaggctttttctcctacagaatggcccagatgacattcctgctgagtagccaaaacgattctacactttaaaccttcagtccatagcaatgcaaaggtgtgggtagataagctgttagcttttcctcaagtatgctagtatgagggatggtcctttgtggaggctgtatgttcaaggagaaattgatgatgctccttcaacaaatacttgaggtatttcctgtatactccgtgtgatatgcttttcacataataaaccaaaccagctgtgtggcccttagaaatcactggtcatgtagatgctttgtataattcttggccacccatcttttagagactttgtaaacagtaagcttatggggagaaaagtcctttgataaaaccacgagaggagatactgtatggagacatgaggagatactgtgtggagacgaggagatactgtatggagacataccatgggcccttcaaggagcacctctgtatgggctggcaaatccctttcactcatctagaaagaagcagacacttgtcatcatgggaatattttattgggtataagtgttttaggtaattgataactgatttttctactgtttttaagtgattacttcaaatgtgatttgaagcattgtttggcctgaagct

SEQ ID NO: 406515 - DNA, 1700 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatggtaagcattctccagaccgccacccagtttctccagttctccccgtccccatcccagcaaactgggtactaaatataactccatttctttatcttttttgtatcactaaagtcaaatgcctagcaacttgtaaaactgcaggtgaccactactaattttcctttctgggtggcacagagtttgaaaataagagcaaagcattctgggtcaagtgcaaacttttggtagaggctttttctcctacagaatggcccagatgacattcctgctgagtagccaaaacgattctacactttaaaccttcagtccatagcaatgcaaaggtgtgggtagataagctgttagcttttcctcaagtatgctagtatgagggatggtcctttgtggaggctgtatgttcaaggagaaattgatgatgctccttcaacaaatacttgaggtatttcctgtatactccgtgtgatatgcttttcacataataaaccaaaccagctgtgtggcccttagaaatcaaaaaaaaaaaaacaaaaaaaacaaaacaaaaaaaaaaaacacccgggggacaataacgggggggggcaaaaaaggggttcaataaaacggcccaggggcaccaaggggtgtccgaccccttttttttcaccaccagggggaaaacgcgggggccccaaaaggggggcggaa

SEQ ID NO: 406516 - DNA, 2790 bp, Homo sapiens
gggcaggtctcgtgggctacgtggttaagtcctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406517 - DNA, 1394 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggccaggggatggaggtatgttctgcaactcctggtggccgagcgtgtatgacttagtgtagtggtgatggctgcagacattttgggttgttttggtaggctcttgacgttagctttgttttcacttgcactttgtctgtttagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacaga

SEQ ID NO: 406518 - DNA, 2973 bp, Homo sapiens
agtggttaaaaggtaagtttttatatgttctgtatattttacataatacgcagattcatatctataaaaatatacatactatcgaatatgctttaaattttgctacttaacattatgtggagaacaataacttcatactgctcgagtttgacaatgtatataaattaagttagcagaaacccaggcttctgtgaaattctcaaagcctttttgacgcctcttgtataaaagtcttccgatgttaccactccaggccttgctgaaatgttttccttctgtttatttccaggggatggaggtatgttctgcaactcctggtggccgagcgtgtatgacttagtgtagtggtgatggctgcagacattttgggttgttttggtaggctcttgacgttagctttgttttcacttgcactttgtctgtttagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406519 - DNA, 2030 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggccaggggatggaggtatgttctgcaactcctggtggccgagcgtgtatgacttagtgtagtggtgatggctgcagacattttgggttgttttggtaggctcttgacgttagctttgttttcacttgcactttgtctgtttagagtttgtggaagtcatttctttacccaagaatgacctgctgcagagacttgatggtaagcattctccagaccgccacccagtttctccagttctccccgtccccatcccagcaaactgggtactaaatataactccatttctttatcttttttgtatcactaaagtcaaatgcctagcaacttgtaaaactgcaggtgaccactactaattttcctttctgggtggcacagagtttgaaaataagagcaaagcattctgggtcaagtgcaaacttttggtagaggctttttctcctacagaatggcccagatgacattcctgctgagtagccaaaacgattctacactttaaaccttcagtccatagcaatgcaaaggtgtgggtagataagctgttagcttttcctcaagtatgctagtatgagggatggtcctttgtggaggctgtatgttcaaggagaaattgatgatgctccttcaacaaatacttgaggtatttcctgtatactccgtgtgatatgcttttcacataataaaccaaaccagctgtgtggcccttagaaatcactggtcatgtagatgctttgtataattcttggccacccatcttttagagactttgtaaacagtaagcttatggggagaaaagtcctttgataaaaccacgagaggagatactgtatggagacatgaggagatactgtgtggagacgaggagatactgtatggagacataccatgggcccttcaaggagcacctctgtatgggctggcaaatccctttcactcatctagaaagaagcagacacttgtcatcatgggaatattttattgggtataagtgttttaggtaattgataactgatttttctactgtttttaagtgattacttcaaatgtgatttgaagcattgtttggcctgaagct

SEQ ID NO: 406520 - DNA, 2815 bp, Homo sapiens
gagaatcgcttaaacccaggaggcagaggttgcagtgagccgagatcacgccattgccctctagcttgggcaacagagcgagactgtctcaccaaaaaaaaaaaaaatcattatccctgatgttcttgtctcatgctaggaatgtaatcttgcctttatagtctttattctttaagatccttatagaccaaaaaaaacgttatcaccagcatctagcataggaagtgacatatagtagtacctgctgcgcaaacactgattgaataagatgttttgtccttccttaacggcatgatctaagttgttttctttgctttccacagctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406521 - DNA, 1143 bp, Homo sapiens
tctcttgatttcaatgattgatagcatgtggctttcagacctaaggaagagttagagctttggagaatcacaatgcctgtgattgaaatcaggatttaaaaaagggttagaggcataggggaaggctaccattacaggaagtagttggatcttaattttcacatgtatagggctagacagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406522 - DNA, 1256 bp, Homo sapiens
  misc_feature (835)..(835): n is a, c, g, or t
  misc_feature (837)..(839): n is a, c, g, or t
  misc_feature (842)..(842): n is a, c, g, or t
  misc_feature (848)..(849): n is a, c, g, or t
  misc_feature (892)..(892): n is a, c, g, or t
  misc_feature (895)..(895): n is a, c, g, or t
  misc_feature (906)..(906): n is a, c, g, or t
  misc_feature (913)..(913): n is a, c, g, or t
  misc_feature (917)..(917): n is a, c, g, or t
  misc_feature (924)..(924): n is a, c, g, or t
  misc_feature (938)..(938): n is a, c, g, or t
  misc_feature (944)..(945): n is a, c, g, or t
  misc_feature (950)..(951): n is a, c, g, or t
  misc_feature (954)..(954): n is a, c, g, or t
  misc_feature (962)..(962): n is a, c, g, or t
  misc_feature (974)..(976): n is a, c, g, or t
  misc_feature (978)..(980): n is a, c, g, or t
  misc_feature (991)..(991): n is a, c, g, or t
  misc_feature (995)..(996): n is a, c, g, or t
  misc_feature (998)..(999): n is a, c, g, or t
  misc_feature (1007)..(1009): n is a, c, g, or t
  misc_feature (1017)..(1017): n is a, c, g, or t
  misc_feature (1024)..(1024): n is a, c, g, or t
  misc_feature (1026)..(1027): n is a, c, g, or t
  misc_feature (1029)..(1029): n is a, c, g, or t
  misc_feature (1035)..(1037): n is a, c, g, or t
  misc_feature (1039)..(1039): n is a, c, g, or t
  misc_feature (1049)..(1049): n is a, c, g, or t
  misc_feature (1056)..(1056): n is a, c, g, or t
  misc_feature (1058)..(1058): n is a, c, g, or t
  misc_feature (1060)..(1061): n is a, c, g, or t
  misc_feature (1067)..(1069): n is a, c, g, or t
  misc_feature (1076)..(1077): n is a, c, g, or t
  misc_feature (1079)..(1080): n is a, c, g, or t
  misc_feature (1084)..(1085): n is a, c, g, or t
  misc_feature (1091)..(1092): n is a, c, g, or t
  misc_feature (1096)..(1096): n is a, c, g, or t
  misc_feature (1110)..(1110): n is a, c, g, or t
  misc_feature (1114)..(1115): n is a, c, g, or t
  misc_feature (1129)..(1130): n is a, c, g, or t
  misc_feature (1137)..(1137): n is a, c, g, or t
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacatnannnaanaaaaannaaagataaaaaaaaaaaaaaaaaaaaaaaaaaaaaaaaaaaanaanataaaaaacanaaaaaangganatgaaanaaaaaaaaaaaaanaaaaannaaaannagngaaagganagtttgtggaannnannnccccccccccnaccnncnngccgcagnnnccggacgncctgggngnngnaggacnnncnccagtggacncccgggncncnncccccnnnccccccnngnncccnnccaatnncaanccctttggagtgcncttnntttttttttatgtnntattatntttcactggccatttttgtaaacgagaccaccaggccttcttcactaagactttgtattcaacttagtttaatgtagatttgccattagctttttcgtaaaataaaagcacagaacaga

SEQ ID NO: 406523 - DNA, 1329 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagtgtttgggatgggaccttcagtgcttttcccagcactgtcttcttcagtctttaggactaaccttaggaggcagcagagagagctatgccaaaagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggtatgtgtgtgtcggctgtgatgaaggtggtgtggttgcattacgtgtcttggaacttgctgctagtttgatttattaaaagaatgtagtctttcatggaaagaatcggtctttcaaatagacttcatcagtattcttgtctctcttcctaatcatgtattttagcatttttcttttgccacttcattcatctttacgctttctttgtaaaaaaatgttaaatgacatattgccctgtattctatatgaagtgtatccccacttagtaatatgag

SEQ ID NO: 406524 - DNA, 1254 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacaga

SEQ ID NO: 406525 - DNA, 1010 bp, Homo sapiens
  misc_feature (950)..(950): n is a, c, g, or t
  misc_feature (953)..(953): n is a, c, g, or t
  misc_feature (957)..(957): n is a, c, g, or t
  misc_feature (969)..(969): n is a, c, g, or t
  misc_feature (973)..(973): n is a, c, g, or t
aattagctagtacgaggctgggtgttaatcggccgagggcggggtcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttctgaatttaagccaatatgacactggcatttgttaacgagaccacaggctctcatagactgtcatagttagggaatgctagtttcggaataaagccgacaaaaaaaaaaacgggttttgggggggagggganggnggtngcccttgaaggntggnctgtgtgtgtgagtaaagaagacaaaactgaaatgaa

SEQ ID NO: 406526 - DNA, 3454 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttctttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406527 - DNA, 1305 bp, Homo sapiens
  misc_feature (1245)..(1245): n is a, c, g, or t
  misc_feature (1248)..(1248): n is a, c, g, or t
  misc_feature (1252)..(1252): n is a, c, g, or t
  misc_feature (1264)..(1264): n is a, c, g, or t
  misc_feature (1268)..(1268): n is a, c, g, or t
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttctgaatttaagccaatatgacactggcatttgttaacgagaccacaggctctcatagactgtcatagttagggaatgctagtttcggaataaagccgacaaaaaaaaaaacgggttttgggggggagggganggnggtngcccttgaaggntggnctgtgtgtgtgagtaaagaagacaaaactgaaatgaa

SEQ ID NO: 406528 - DNA, 3603 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagtgtttgggatgggaccttcagtgcttttcccagcactgtcttcttcagtctttaggactaaccttaggaggcagcagagagagctatgccaaaagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406529 - DNA, 3547 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaagaaataaagagaaaacaacaacattgctaattttgagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtcttttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgttaaaaaaaaaaa

SEQ ID NO: 406530 - DNA, 1330 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgagactttgtaaacagtaagcttatggggagaaaagtcctttgataaaaccacgagaggagatactgtatggagacatgaggagatactgtgtggagacgaggagatactgtatggagacataccatgggcccttcaaggagcacctctgtatgggctggcaaatccctttcactcatctagaaagaagcagacacttgtcatcatgggaatattttattgggtataagtgttttaggtaattgataactgatttttctactgtttttaagtgattacttcaaatgtgatttgaagcattgtttggcctgaagct

SEQ ID NO: 406531 - DNA, 1293 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaagaaataaagagaaaacaacaacattgctaattttgagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacaga

SEQ ID NO: 406532 - DNA, 1234 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggtatgtgtgtgtcggctgtgatgaaggtggtgtggttgcattacgtgtcttggaacttgctgctagtttgatttattaaaagaatgtagtctttcatggaaagaatcggtctttcaaatagacttcatcagtattcttgtctctcttcctaatcatgtattttagcatttttcttttgccacttcattcatctttacgctttctttgtaaaaaaatgttaaatgacatattgccctgtattctatatgaagtgtatccccacttagtaatatgag

SEQ ID NO: 406533 - DNA, 1353 bp, Homo sapiens
gaactctgggcgccggccccggaagtgcccgccgagctattttggttcaaggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggagtaagtaaccggggcaagccagtcacagcacaaaacctctttggggaggagaagaagaaggggaaagggaccacatctgcatgccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttctgaatttagcccaatgacactggctttgaagagacccggctctcctaatggtcctgtaggggtgctcgttgaaaggcgaagaaaaaaacggtttggggagagaagggctctcctttggacgctttagtgctcctagagaccgcgaagcc

SEQ ID NO: 406534 - DNA, 710 bp, Homo sapiens
ttggagtaagtaaccggggcaagccagtcacagcacaaaacctctttggggaggagaagaagaaggggaaagggaccacatctgcatggtgcgtgcagccgcgcggtgtctcccaggctgcggctgggcacgcgtccaggcgcccaagagggaaactggggattggagggaaattgtggattggagaggaagagcctgggctactccgagtaaagaaagcggggaacaccacagctaagtgttagttccagtgtaaagattgcagcatctgcagaggagtagaatgcttggtagagggaataccgcctgtacgatcctggagggttcgactttgggaggtaaaaggcgagaggtaaatgtgagaaagcagaggaaagaggagtctccttggagcgctgaattcgtttagtctggcctcgcaaaagttgtcaacctggaaaaaacgcagatttttatcagtattcctgcgatgatcgaatcataagactggaagaattcgaatcgaacttgtactatcgttttttcctttgcttcactcctgtcacccagcaaagttcagttttgtttgtttcgttaaaagaatgagaagtaactagctgcttttatttatttatttgagacggagtctcactctgtgcccagattggagtgcagtggcgcaatcttggctcactgcaacctccgcctcctgggtttaagtgattctcctg

SEQ ID NO: 406535 - DNA, 1414 bp, Homo sapiens
aaaaactccctgctagagagactaggagatttggggctgcggccgtttcctccggagcacccacgggactgtgtgctggggtccctccaccggctgtgtcctttattcttctttctcacccaacgatttacctgaacggttataaagtgcacgttatttccctaagcactttgagtatattggcccactgcattctggacttcaaaatttctgatgcgaaatatgctgatacttttgttgaagaaatctgggctttgagcatctgtaagatatttgttggaaggttttgtctggtccttcttactgatgtgttgctcttcttcatggctcgtgaaaactattagagtcatccaagggtgggaagagagatcagcaacgttaactgggtgtcaagaaaacataccgagattgaagccatccacttctgcaggaacaccgaaaagaaagcttacaatctgaaggtgtccgttcttacactggtcagaccactgtccttggggcagctggggtctttgggaccctccaccgggctcgccggtccgtcggacttttggctgagatccgtgtcagactcctccgaatagtcgtctgttggcatcgagggctgaacccctgaggtgctgcatgaacttgagagcgcgctctcgcacgccaggcagtggtacgagccgccgccgccgccgccgccgccaccgccgccgccgccactgccaccgccgccgccgccggtggggacgtgaagcaccatctcttgcaggttcaccacagactggccgaagaagcagagggacttcaggtggctcctcgctgcctcctcgtcgctgaagccctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcag

SEQ ID NO: 406536 - DNA, 533 bp, Homo sapiens
aaaaactccctgctagagagactaggagatttggggctgcggccgtttcctccggagcacccacgggactgtgtgctggggtccctccaccggctgtgtcctttattcttctttctcacccaacgatttacctgaacggttataaagtgcacgttatttccctaagcactttgagtatattggcccactgcattctggacttcaaaatttctgatgcgaaatatgctgatacttttgttgaagaaatctggtccttcttactgatgtgttgctcttcttcatggctcgtgaaaactattagagtcatccaaggtcctgacatccactgccttcactcaaacccttctggccagttccatcctacagattctaagttcctgactcagaatcttactgttgtgaacctttacacccaggtttggagacagaaaggagcaccgccaagtgaggcagagcagtctcagaaacataggaaaatcttctagcagagatggaataatagagaccagatgtaccctcccagctgaaacaac

SEQ ID NO: 406537 - DNA, 783 bp, Homo sapiens
aaaaactccctgctagagagactaggagatttggggctgcggccgtttcctccggagcacccacgggactgtgtgctggggtccctccaccggctgtgtcctttattcttctttctcacccaacgatttacctgaacggttataaagtgcacgttatttccctaagcactttgagtatattggcccactgcattctggacttcaaaatttctgatgcgaaatatgctgatacttttgttgaagaaatctgggctttgagcatctgtaagatatttgttggaaggttttgtctggtccttcttactgatgtgttgctcttcttcatggctcgtgaaaactattagagtcatccaaggtaagcgcattgcacaggggtgacaaaaaaatgggtggggtggtgggggagaacataggtatatacccaagaggaatgaaaacatactttcacacataacttgtgcacaaaagttcatagcagcattagtcataatagctaaaaagtagaaatattcatcaactgatgagtagctaaatataatgtgttatgtctttataatggaacattatttggcaataaaaaggaatgaagtactgatacacaataccacagggatgaaccttgaaaacattatgtaagtggaagaagccagtcatgaaagaccacttattatatgattccacatataagaagggaagtgggggtgactactaaaggatatggggtttcttttggcgatgatgaaaatgttctcaattaattgtggtgatggttgcaaaactctg

SEQ ID NO: 406538 - DNA, 2058 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagtatgtgggtgtgcatttttcccttttaaaataaactaagttgtttggcgtactttcttacag

SEQ ID NO: 406539 - DNA, 516 bp, Homo sapiens
atgaagactacatgatgtttttcttctattgaactaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcaggtatctagggtttgatgtggatatgctaaattaattttttgcttataaaatctcactttgtttttaatgtaaagaacttaccaaattttatatttttatcttataaaataagaataaaaatatttggtgaggtggggaggtttcttcatatctgaaaacttctgagatgaactgtagattgggctttttattttatatttctttaaatatttagtcagtttttatcaccaaa

SEQ ID NO: 406540 - DNA, 7712 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaagaa

SEQ ID NO: 406541 - DNA, 8732 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaatattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaagaa

SEQ ID NO: 406542 - DNA, 8989 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaagaaaaaaaaaaactcgtgccgctcgtgccgaattcggcacgagggaaaacattctgcttttaggtagtttcaaaattcaggggagggagcctgaaatttttgccatgattggtttgttagaaagagcaggcatcagactacttctgataaaattgtttggaaggtcacgacctcgcagatcctccgcatattatctcaacagaggacag

SEQ ID NO: 406543 - DNA, 8217 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatattcttaataaaatttatgtaccatacttgtcattgcgtagacttcttatcaaaatttcacatttatctgtaggaaaatgtaaagttggtaaaaattgtttacacaaatcacacattttccatccttgacaattgcagtgttttttttttaaaaattgctgtattagacaattttaactcaagtaggttgtagaggggagagggta

SEQ ID NO: 406544 - DNA, 7548 bp, Homo sapiens
ggattacaggcatgagccaccgtgcctggcctctcctactttttaatctatattgttcttcctccagtggaacactagaaatctctagccaggaactagtgtggtcacatggctgtgggaaaatagaggatgtacaaataaaagttaaagctatttacgcagcagcgttgtacccacgcacatcgttctagcctgacttactgttcgtcaactcaaacgtaatgtttacttgaggtaaaaaccacagtacacatctgtgttattgtacaaagtctaattacatgtttatttttaaggaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaagaa

SEQ ID NO: 406545 - DNA, 2010 bp, Homo sapiens
aatcatgtgcagattgcattctgttatgttgagctcccatgtaactatatttcacttgatacttttatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaagaa

SEQ ID NO: 406546 - DNA, 1349 bp, Homo sapiens
tatgacagttccatgtaatatttttccagttaattttgtttaaaagtgagatgataatataaaaggatctcatataatagaataaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaagaa

SEQ ID NO: 406547 - DNA, 1868 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggtaatgcagcagtaaccgcttagtagatatgactcttttggttaaagtacaattttaaattggcaactcaactatttttgtaccaggaaattacctacaaaagaaagatacagaacaaggataagccatgagagagaatttatggaacagtgcaatctataaatactgatcaataaaatatatgaataaaacag

SEQ ID NO: 406548 - DNA, 1581 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcaggtatctagggtttgatgtggatatgctaaattaattttttgcttataaaatctcactttgtttttaatgtaaagaacttaccaaattttatatttttatcttataaaataagaataaaaatatttggtgaggtggggaggtttcttcatatctgaaaacttctgagatgaactgtagattgggctttttattttatatttctttaaatatttagtcagtttttatcaccaaa

SEQ ID NO: 406549 - DNA, 8783 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaagaa

SEQ ID NO: 406550 - DNA, 8804 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgtgtctgcttatgccgaccccctgcccctcacaggctgcgtgcccggaggctgtcctcctct

SEQ ID NO: 406551 - DNA, 7564 bp, Homo sapiens
ggattacaggcatgagccaccgtgcctggcctctcctactttttaatctatattgttcttcctccagtggaacactagaaatctctagccaggaactagtgtggtcacatggctgtgggaaaatagaggatgtacaaataaaagttaaagctatttacgcagcagcgttgtacccacgcacatcgttctagcctgacttactgttcgtcaactcaaacgtaatgtttacttgaggtaaaaaccacagtacacatctgtgttattgtacaaagtctaattacatgtttatttttaagagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcaatttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaacgtttatgcatctaggcaaattttgttttcttataaagatttgagagcccatttatgacaaaatatgaaggcgaaatttaaggacaattgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaagaa

SEQ ID NO: 406552 - DNA, 5153 bp, Homo sapiens
  misc_feature (1)..(1): n is a, c, g, or t
  misc_feature (4)..(5): n is a, c, g, or t
  misc_feature (7)..(7): n is a, c, g, or t
  misc_feature (9)..(9): n is a, c, g, or t
ngcnngngnggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcactttgggaggccgaggtggagtgatcatcagcctgggcaacacggcaagaccctatctctatt

SEQ ID NO: 406553 - DNA, 3761 bp, Homo sapiens
  misc_feature (1822)..(1822): n is a, c, g, or t
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacncgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaaca

SEQ ID NO: 406554 - DNA, 3666 bp, Homo sapiens
  misc_feature (1727)..(1727): n is a, c, g, or t
ccgcgcaacagaagttactaggtgcgtgctcggtgtttaatttcgtacgagttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacncgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaaca

SEQ ID NO: 406555 - DNA, 3707 bp, Homo sapiens
  misc_feature (1768)..(1768): n is a, c, g, or t
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacncgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaaca

SEQ ID NO: 406556 - DNA, 3924 bp, Homo sapiens
  misc_feature (1985)..(1985): n is a, c, g, or t
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatcttttgctgtgttgtgtgcctgctgcatgatgtgcctgcctgctgctgctgtgctgatgtcctgctgcatgcacctgcaccctgctgtctacgcatgctctgtgttgatgtgcctgcctgcctgcgcttctctgtgtgattgcctgctgggcctggtgtgtcctgctgcatgctgcttgtgtgctgtgacctgtactgctgtgtgccttgttgtgtgtgtgttgcatgtgcttgcatctgcacattgactatgctacttgtgatgccttgtgaccctgtgctggctgcctacttgagatcactcttctggatggcattccttgacaaactagccaatgcatgttgctatctacagagtgaccatactggctcatgtggtcaaccaaagatgcagccctaggacgttcccatgtgtgacttaccttgtgttgtgtcactattgactgtacgactttgtactgagtatatgaacgatccttgagtgtgtacacatgtgttactacaaatgatgagtgcatgacaccatgtattgataagtataacctatacaacatgccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacncgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaaca

SEQ ID NO: 406557 - DNA, 2155 bp, Homo sapiens
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttacaatacaagatgattcaaaattatatagatatttaaagcttttctgctgtttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaaca

SEQ ID NO: 406558 - DNA, 1880 bp, Homo sapiens
gcactgagccgccgccgcttccggaagcgcagacccgctggtgccacgtttatccccttacatcctcctaggacccggtcggtagtcgtcgccccagcccgccgggggcaagcgcccaggtccgcggccctcgagacgggaccgagagcatcatgggcagcactgtcccgcgctccgcctccgtgctgcttctgctgctgctcctgcgccgggccgagcagccctgcggggccgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaacaaactgactttacttgtttctgtcaggatttaaatctttctaaagctccttataaacttaaagcctagagtacagttctgtaatgagagtgattatttatttggtattttattaaaatatctgagggactgtccaagaaagaaggtgaaagagaaataccacgtctgtactgcctaatttgtaaccttctctttgcattccttactgaaagtttgtgtaggtgaaaagcagttaaatcatcagttgctctaaagaggtcttaatttttaagtaaattacctttagtttgtatattacc

SEQ ID NO: 406559 - DNA, 1237 bp, Homo sapiens
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccaggtaaataaaaaaatcagcaatataatgttggtatatttaaaaggaggaaaaaagcataatttaatatcatgcactaactgatgagcatggaattttgagactgacagtctttaaaatctatcttaattcttacatgtaggcatttcacagagaacttcagacttttgtagtgaaaaataatgttgaaagattttatgaacttttaattgtaaagagaaagaagcattaaaataaggaggaagatcactaaggtagaaacatcagtggtaaaagaaggttgggaaggctgagcagtgttccaatcttctgaagcattttctttaatccctgaaggaatgttgctgtcatactcaggaggctggtgtaggttacacgctgtatccagtttcgttcactgaatgttctaacagtgtatgaa

SEQ ID NO: 406560 - DNA, 4058 bp, Homo sapiens
  misc_feature (1822)..(1822): n is a, c, g, or t
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacncgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaacaaactgactttacttgtttctgtcaggatttaaatctttctaaagctccttataaacttaaagcctagagtacagttctgtaatgagagtgattatttatttggtattttattaaaatatctgagggactgtccaagaaagaaggtgaaagagaaataccacgtctgtactgcctaatttgtaaccttctctttgcattccttactgaaagtttgtgtaggtgaaaagcagttaaatcatcagttgctctaaagaggtcttaatttttaagtaaattacctttagtttgtatattacc

SEQ ID NO: 406561 - DNA, 3638 bp, Homo sapiens
  misc_feature (1699)..(1699): n is a, c, g, or t
ccgcgcaacagaagttactaggtgcgtgctcggtgtttaatttcgtacgagttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccgggggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacncgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaaca

SEQ ID NO: 406562 - DNA, 3580 bp, Homo sapiens
  misc_feature (1822)..(1822): n is a, c, g, or t
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacncgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgtttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataacaaggtgggggtcaaggttcacaaggtggggataattgaacaaggggggagacatttttcggatgataatcgcagatgggggaagggaaataagacagggcgtgtgaaaaaacgggggtaaaaagaggt

SEQ ID NO: 406563 - DNA, 2133 bp, Homo sapiens
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaacaaactgactttacttgtttctgtcaggatttaaatctttctaaagctccttataaacttaaagcctagagtacagttctgtaatgagagtgattatttatttggtattttattaaaatatctgagggactgtccaagaaagaaggtgaaagagaaataccacgtctgtactgcctaatttgtaaccttctctttgcattccttactgaaagtttgtgtaggtgaaaagcagttaaatcatcagttgctctaaagaggtcttaatttttaagtaaattacctttagtttgtatattacc

SEQ ID NO: 406564 - DNA, 1636 bp, Homo sapiens
  misc_feature (1085)..(1089): n is a, c, g, or t
  misc_feature (1091)..(1092): n is a, c, g, or t
  misc_feature (1098)..(1099): n is a, c, g, or t
  misc_feature (1101)..(1102): n is a, c, g, or t
  misc_feature (1106)..(1106): n is a, c, g, or t
  misc_feature (1110)..(1117): n is a, c, g, or t
  misc_feature (1120)..(1120): n is a, c, g, or t
  misc_feature (1127)..(1129): n is a, c, g, or t
  misc_feature (1147)..(1150): n is a, c, g, or t
  misc_feature (1155)..(1155): n is a, c, g, or t
  misc_feature (1157)..(1157): n is a, c, g, or t
  misc_feature (1159)..(1161): n is a, c, g, or t
  misc_feature (1163)..(1163): n is a, c, g, or t
  misc_feature (1165)..(1165): n is a, c, g, or t
  misc_feature (1172)..(1172): n is a, c, g, or t
  misc_feature (1179)..(1179): n is a, c, g, or t
  misc_feature (1182)..(1182): n is a, c, g, or t
  misc_feature (1189)..(1189): n is a, c, g, or t
  misc_feature (1205)..(1205): n is a, c, g, or t
  misc_feature (1208)..(1208): n is a, c, g, or t
  misc_feature (1220)..(1220): n is a, c, g, or t
  misc_feature (1226)..(1226): n is a, c, g, or t
  misc_feature (1229)..(1230): n is a, c, g, or t
  misc_feature (1232)..(1232): n is a, c, g, or t
  misc_feature (1244)..(1246): n is a, c, g, or t
  misc_feature (1248)..(1248): n is a, c, g, or t
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggcacagtgtggatacaagtccaggatatcatgagtcagattccaagaagtctgaagatctatccttgtgtaatgttgctgagcacagcaatacaacagaggggccaacaggaaagcaggagggagctcagagcgctcnnnnngnngtcccnncnngacnctgnnnnnnnnctnccccccnnntcccccacaccccacccnnnngaccncncnnncnanccccccncaccccncanccccccncaagaccacccccccnccncccccccaacancccccnccnngnccccacgtcccnnncnccatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaa

SEQ ID NO: 406565 - DNA, 504 bp, Homo sapiens
gccaggttttgtcacttaaataatcattttatttaagcctttaagcattttattggattggctgcttgtctttgttttaactcatttctctagttttgatcagttctccgaagccagggtcaacctcagcactgtcaacatttacggctggataatgttggtttggggagctgtcctgcgcattgtaggatgcttagcggcatccccagcctctacctgttatatgctaatagcccccccgacccctgagttgtgacaaccaaaaatgtctacatgtgacaacaaatgttccctggggaggtggggggaaagtcacacccactcgagaaccactgtttctaaaccgcccttttgtattttgctattttatgttcaacctgaaaatggttaatctggtaatgttactattctattaagaaattgatatgaaaatgttactgcgattccaaggagggcaaagcgtcctgcggtgagtgttcccgacgccggagttggcgcggccgc

SEQ ID NO: 406566 - DNA, 4902 bp, Homo sapiens
cccggggggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatatgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcccttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgca

SEQ ID NO: 406567 - DNA, 5176 bp, Homo sapiens
gccaggttttgtcacttaaataatcattttatttaagcctttaagcattttattggattggctgcttgtctttgttttaactcatttctctagttttgatcagttctccgaagccagggtcaacctcagcactgtcaacatttacggctggataatgttggtttggggagctgtcctgcgcattgtaggatgcttagcggcatccccagcctctacctgttatatgctaatagcccccccgacccctgagttgtgacaaccaaaaatgtctacatgtgacaacaaatgttccctggggaggtggggggaaagtcacacccactcgagaaccactgtttctaaaccgcccttttgtattttgctattttatgttcaacctgaaaatggttaatctggtaatgttactattctattaagaaattgatatgaaaatgttactgcgattccaaggagggcaaagcgtcctgcggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatatgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcccttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgca

SEQ ID NO: 406568 - DNA, 4132 bp, Homo sapiens
gactgaggcaggagaatcgcttgaacccagggggcggaagttgcagtgagccaagattgcgccactgcactccagcctggcgacagaacgagactctgtctcaaaacaaaaaaaaaggcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagagcaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatatgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcccttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgca

SEQ ID NO: 406569 - DNA, 4588 bp, Homo sapiens
cccggggggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatatgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcccttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttttattgccattgtgtagattgatgggggatccatcatacagtcgacc

SEQ ID NO: 406570 - DNA, 1669 bp, Homo sapiens
cccggggggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagcaccctcacagacacaccgaggatcggtactttgcatccttcaatccaatcaagttgacactcagtattaaccatcacaactactgaaaaagcattaaaattctgtaaacattaatggtcttcctgcatcctgtttataagcaaatttgaaatttaaaaaatttgtgtgatgttagaaggcagcaataaatgtagaaaatta

SEQ ID NO: 406571 - DNA, 574 bp, Homo sapiens
cccggggggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggtgagcgagccgggccggcgggcgtgggaagccgggcgcccgggtctcgggatcccagggtcccccagcgaggacgcgagggggccggagcccctggccccagtgccacggccgagacggagggggcactctcgggagggccgcggcgccggcttagcggggcagcttcgcggtgcctgttctgcaggaaaatcctaaccggtgcccggactctcgaaatcgtggtggtctccccagagtcgggagacggacgcccgtctggggtagattgtgtgaggtgaaggacggcgcgcagtgccagggaacgccccagagccgtagttaatggccggggctgaccggtgggtgctgcggtgggagcgtcccgggagcgagggcg

SEQ ID NO: 406572 - DNA, 4898 bp, Homo sapiens
cccggggggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgaggttagtacctgtctcctttgaggacccagagttcaagtcgtctttcagccagtccttttctttgtatgtcaagtatcaagtggccatacaccaggatccacccgatgaatgtgggaagactgagcaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatatgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcccttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgca

SEQ ID NO: 406573 - DNA, 4824 bp, Homo sapiens
tggtcggcccgagcggaccctcgcggcggccatggcgtcggtggtggaatacaagggcctcagggccggctaccactgcggctacctgcgattccaaggagggcaaagcgtcctgcggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatatgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcccttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttaacgtgtcagaatctattatgtaaaagaacctttccagatttctgaacagtatatgctttgattttataggctttatattatttcagtatgaataaagataaggaatatgaaacagttaactaaaatgtatctgtcgttgctaacttgaaaaatgaagtagaaacagttggaaaatgtttgaattagaagttattcaagtgcacactcttttctaaaagaaagccaatgactataaggcaaaagaagtttgactgcatgtggtattttttgctcttgtatatgctttttgaacaagctatttgataaagcctgaatggaaaaaataaagctgtttctatctgca

SEQ ID NO: 406574 - DNA, 4595 bp, Homo sapiens
cccggggggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatatgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaattttaaactttcctctaaaatgtactgaattttgacaaaaatttgaaaatatcctcagctaactagaataaaaaggatcataaaacaatgattttaaaactgaaatctctagaaactcaacatccaagtcagccgcatttcttcattcagagtgtgtgtgtcacacctgccaaggtgctgcgtactctgctaaccgagctagagtagtgagcaaagccattttctctgatcacaagattttacatttttctgggattttgacctgcaaagtagtctcgtaagagcatttgagagacttacttggaactgccttcagaatctatagagccttttttctctttttcctctaaaatgaaaagagcttcattttatgattataacaaaagtgacactgtaagcagttagaacattaagaagtataaataaaaagtaaaaatcatctacaaccctaccatactcagaaggagaaaagaactgtcatgtatgtatacacacatacctatgtaattttaatataaatagaattatgttctacatgctgttttatttcctcaacagtaaattatggacatgtctgaaatgtgaaataaatttcaaaataaggcttcagaaagtgtagtaagtaatctctgcattattaaaaataagcagggtagggctggtacttggctcccttagcatttgaatgtccaacttggtgttatcactgtatcttccctccatttgtctttgtgattagcatgtaaaatggtattcataaagatcacaacccttgaatatcagatgaagagaaaacttgactccaacatcttaccacaactctggtttcttcctgcagaattcattttcagaggaaaatgatgaatcatccctgtctgtgaaccactgtgctttccttgagggtggcattgtaggttgacaccagcaaagactcagagtgacttgagcattggagatccttctacttggctgctgtattcatgcattatgttggtttgagaatagctagtgtattgatccaagtagtcaaagtgtcttaaaaggacacctatttgtccttttgagccccagctgagtgaatactgatagtggactagaaaagcatagtcaagaaaagtgacccaccttgttacttgaccagcagtctagctgagagatctgattttatgttcgtaactttctgtaaagaaagacacaaggacttttcaaagacagtttatatctttccaaggcaggaagctttgcatttgcaatcttagtgttgtgtccctttctgattttcaaatacatcacacctgccttcctgttttgggagcaaagatgtaatttcaattccccttgctaccgtccttatttaaattatttccattctaagagatttttgttatttttttaaatgtaatctgagcacttttttgtattctaaaagatagatgatatcagataaatatgttgtacatttgattaaaattatttagataaatattactatgttgacttttaaatagctttatcctatttttcattcattttgcaaatatttgttgtgtgtagtttcttacccgccctcggaatcccttatccaggtgaaccccgc

SEQ ID NO: 406575 - DNA, 1192 bp, Homo sapiens
cccggggggcgcgctgcattgtggggtggcggcggcggccgcgctagcgacgcggggccgggcggctgagcgttcgcggggccgaggccatggctttctgggcggggggttcgcccagcgtcgtggactatttccctagcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctggctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgaggttagtacctgtctcctttgaggacccagagttcaagtcgtctttcagccagtccttttctttgtatgtcaagtatcaagtggccatacaccaggatccacccgatgaatgtgggaagactgagattaagaaattgctactcgggaagctaaagcgggaaaatcgcttaaacccaggacgcagaggttgccgtgagctgagatggtgccactgaactccagactggatgcagaatgagactctgtctcaaaaaaataaataaataaataagttgattactactaa

SEQ ID NO: 406576 - DNA, 368 bp, Homo sapiens
ttcccctgcacgtgctctcttgcctgccaccatgtaagacgtggctttgctccttctttgctttctgccgtgattgtgaggcctccccagccatatggaactgtgagtccattaaaactctttcctttataaattactcagtctcgggtatgtctttattagcagcatgagaacagactaatacagtaagtcttcattgaatcatttgggcaggtttatgaaagcaatccagaaccccagagaccacttctcctttatgatcaacaactcccttgtcactgattcttccaactggcattgaaacttgctcaaagcactccctgtttgaaacctacaaaccctttaactattaccacttctctttgatt

SEQ ID NO: 406577 - DNA, 1392 bp, Homo sapiens
agatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaaggcccatgatggaaatttatggcagcagttgggtgccgcagagtggaggtgacaactacctg

SEQ ID NO: 406578 - DNA, 5507 bp, Homo sapiens
agatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406579 - DNA, 4278 bp, Homo sapiens
tgaaccctctgctagatcattctcttctgtagagcctgtccatcttccctttatcagtagtaagctgcccagcctctgtcaactttgcaggtgattttgcttagttctgtctcatcacattcacttgctgaagtgcatagacttcctgcctcttgctggacctctacttttgcttgtgggcagcctcattgaaggcagttgctacggctgacctggaaagaccctgccatgaagataggtgcaggcagagaagtctggatgggaactaagtctagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406580 - DNA, 5138 bp, Homo sapiens
agatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406581 - DNA, 4848 bp, Homo sapiens
agatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406582 - DNA, 2472 bp, Homo sapiens
tgacttagaggatcccggcctcacttggttgcactcattgatcaggaatggatgacgataagtgtccgtaactactgatcttctgcattcaagtgggaggccgggtatcgcgcgcgacttcttaatctttgtgctagctttatgatcgtattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406583 - DNA, 4913 bp, Homo sapiens
agatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttacttttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406584 - DNA, 1563 bp, Homo sapiens
agatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagattctggaggaacgaaatgcctaatcactgttttgaccacgctacggctggaaatgccctg

SEQ ID NO: 406585 - DNA, 248 bp, Homo sapiens
cggactgagaaattgcccatgggctccataaaaaatgtggtcagtgaacctatcgaaggacatgaagactaccacatgatggtaagtagcgctggctgagttcagcccctctcactagactcccacttcacctggcagggaacagttttaactgagcttgtttaacggaagaaaactcagtctccagaagatgcacttttttaagaccctgatgttttcttcatctacttagaacttaatccatggcc

SEQ ID NO: 406586 - DNA, 4550 bp, Homo sapiens
ttttttttgaggggaggagggcaatctggaaatcccgtttgctgtagaactttgatatctaatatggtagctatccacatgtggctggttaaaatgaaattaagaattcagttcctcagtcatagtagctgcatttcaagtgtgtaatagtcacagcagtaggtagtggctagcacaggtacgaacatattcgccctcccagaaagttctgctggacagcactgtgctatagtttcaaaggatccatagtctgtcgtcattaaaagcttttgagccaaaacactaaggctttcttcatcctctctttcaagggaatagtaacacgacgaaatgtagtcagctgtttcatttcattctctcttctgacttatagcaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406587 - DNA, 5391 bp, Homo sapiens
agatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccacatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406588 - DNA, 5404 bp, Homo sapiens
agatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggctcgttttcctcttactcttactttaaccatgtgcctggaggagccattctgggctcttgcacttgcccagcctttctttgccaggggcagagaagggaaagggggtagattgagtgtgccaagggccgtgcaagggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaaaaaaaactctttt

SEQ ID NO: 406589 - DNA, 700 bp, Homo sapiens
caaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaactttaaagagtggataattccattaaccaaccaaaaagaaaagtagtaagataaacattttcttcaaactctgaaaattatcctttttttttttgaaacccccactgtcctcccaagtcacagcaacaagttaaaaagatgatgggaggtggggaagagtggaggagcaggaggaattcttaacagtaagtttcggggtccagggcccgattggcatgtggccccattccaggtcactggggtcatttccaaatttgagttctccaggattgatagcatcatcccatgaggactggggcttagtgaggcagtagctttgatttccagctgagcacaagagtgtgatagtacttgtttgttttttgttgttgttgttttgagatggagtcttgctctgtcgcccaggctggggttgcagtgagctgagatcgccactgcactcaagcctgggtgacagagctagactccgtctcaaa

SEQ ID NO: 406590 - DNA, 1089 bp, Homo sapiens
ggagagccagcctgtccccttgaccacctgggtgcagggactctccccggcacctgacggacagtgggacctgcgagtctcaagggccagatttgcctttcagagctgtcctggaacttacccaagatagggacagtcagacttgcacccaagcattgctggtgcccaaggtttcatcggggcttcacccacttctgttgtcagaggtgtgcatcctcacacaggtgacactggcaggcagtcattttgggaggacatggtaagaaggcgacactttatgtcctgaaatctgatagtattgattgtaatagctgcaaagaccagtgcattatgtaaatttggttttatttattctgctgacatttaaacttttgttaactcagaatatttgagacatacgcacataactgtagcattgtagaatgggtaaggattttgttatctaatcaggaaatctagttctctaaaaaattgccacctgaagaaattctgttaccaccttagagcctgttctgaattttacgaaaattatagattggaaaggactttgtgttctcatgtaatttttgttccttagttacagtgttaagcttggagaggcaaacatgggctgtggtccataccttggttgtcttgttaacccttttgggactgggtactgcttagcaatggtaaatccacttagaacagtatgtggtgttattgtcctgttacttctccccacatacaggtttgtctagcataatttaaaatcagcaggtcttgacaattttgtgaaagtattttcttctttgttaaaaacgtcttggccaggctcagtggctcacgcctgtaatcccaggaccttgggaggctgagatggccgaatcacgaggtcaggagttcgagaccagcctggccaacacagtgaaaaccccatctctactaaaaatacaaaaattatctgggcgtggtggtgggcgcctgtaatctcagctgctcgggaggctgaggcaggagaatcgcttgaacccaggaagcagaggttgcagtgagctgagatcgccactgcactcaagcctgggtgacagagctagactccgtctcaaa

SEQ ID NO: 406591 - DNA, 534 bp, Homo sapiens
  misc_feature (431)..(431): n is a, c, g, or t
  misc_feature (458)..(458): n is a, c, g, or t
atcaaaaagctcagttcgagcggccttagtatagccgttcatattcgcaagaatatgagttccatcgtgatggatgcggtccgttgcttcctgattgctcaggatctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagagganccaggagacctgagcaagccagggganctgagcaagccaggggacctgagcaagccaggagacctgagctagccaggagacctgtgcatgccaggagacctgt

SEQ ID NO: 406592 - DNA, 418 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcactttggcctccactatgtggataataaaggatttcctacctggctgaagctggataagaaggcaagtcaggattaactatttacaggctgtggattgggtgttggtctgcttcatcgataaggaaactggagcaactcaccctgtcttttgttttctgttcctttttgtt

SEQ ID NO: 406593 - DNA, 3417 bp, Homo sapiens
atcaaaaagctcagttcgagcggccttagtatagccgttcatattcgcaagaatatgagttccatcgtgatggatgcggtccgttgcttcctgattgctcaggatctggaaatgtatggaatcaactatttcgagataaaaaacaagaaaggaacagacctttggcttggagttgatgcccttggactgaatatttatgagaaagatgataagattggctttccttggagtgaaatcaggaacatctctttcaatgacaaaaagtttgtcattaaacccatcgacaagaaggcacctgactttgtgttgtatgccccacgtctgagaatcaacaagcggatcctgcagctctgcatgggcaaccatgagttgtatatgcgccgcaggaacctgacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406594 - DNA, 3716 bp, Homo sapiens
  misc_feature (3716)..(3716): n is a, c, g, or t
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagaaaaaaaaaaaaaaaaaaaaaaaaaaaaaaaaaaagaagagaggcgggcgcgcgcgcgcgcatcaataaatatatctctccccagagaggaggcgccacaagcgttaccggcgagacccagaagtattcgtcgggtaacacacaagggtgcgcccacaaataagaggaggcagcgcgagaatatatataagagaaaggagctggcggcccggaggtactaaaaaacacgtggagaaacgaggagaaacaagaggggacataaagagaggaacaaaccttggggggaaaagaggaaccctctaaaaaactgagaggacgaggaggaacacacataattgtgggacacacacaacacccctacacacggacttcttgtaccagcgctctccatcaagagcgtaccaaaaatattaaaccagactctccttctaacccggctcgtgttatctaacagcgggctgtatcaaaaagacaataaaagcgccggaaatatatgcgtcaggcaggcaaggcctatcggagaaaacaagtattgtggcggctgaccaacaccgccgctatggacacacgaccgatgagccaaaaccacatcttttatatacccccggaacggtgatagttgataactcaaaccn

SEQ ID NO: 406595 - DNA, 3012 bp, Homo sapiens
  misc_feature (27)..(28): n is a, c, g, or t
  misc_feature (37)..(37): n is a, c, g, or t
gaggcatgggaataaccgggccccccnntgaggttanggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406596 - DNA, 3140 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctggggacgggccgggccatatggggaggaagggactagaccaacgctgcttaatgttacagacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406597 - DNA, 3245 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaagagacagggtttcgccatgtttgccaggctagtctcgaactcctgaactcaagtgatccacccgtcttggcctcccaaagtgctgggattacaagtgtgagccaccacgctcagcttgcagccttcccccatcccttttgggtgagtgggaagagggggaagaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406598 - DNA, 3035 bp, Homo sapiens
ggacgtgaaatctttacttagagaaaagcgacagagtcagagacccacgggggcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406599 - DNA, 3027 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406600 - DNA, 3081 bp, Homo sapiens
  misc_feature (2227)..(2227): n is a, c, g, or t
  misc_feature (2232)..(2232): n is a, c, g, or t
  misc_feature (2237)..(2237): n is a, c, g, or t
  misc_feature (2244)..(2244): n is a, c, g, or t
  misc_feature (2247)..(2247): n is a, c, g, or t
  misc_feature (2250)..(2250): n is a, c, g, or t
  misc_feature (2256)..(2258): n is a, c, g, or t
  misc_feature (2260)..(2260): n is a, c, g, or t
  misc_feature (2267)..(2267): n is a, c, g, or t
  misc_feature (2302)..(2302): n is a, c, g, or t
  misc_feature (2322)..(2323): n is a, c, g, or t
  misc_feature (2344)..(2344): n is a, c, g, or t
  misc_feature (2356)..(2356): n is a, c, g, or t
  misc_feature (2374)..(2374): n is a, c, g, or t
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggccnccctnacacnagacccnccntcnccaaannncnccccccngcccccccccccgccccacacccgccccgcaaccnaaaagagcccaaactgatcnnttaatccctacgaaggacccncccccgcacatncacacgcccagaggggtnaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406601 - DNA, 2919 bp, Homo sapiens
gtgtatcttgaaccaacctcgcattctaggaataaagcacacttgattgtcacgcactgacttttagttgtgttgttggattccatttgctagtatttcgttgaggattttttcatctgtgttcatcagggatttggcctgacgttttcttttttcattgtgtcctgccagattttggtatcaggatgatgctggcttcagagaatgagtcagggaggagtccttcctccttggttttgtgaaatagtttcagtaggattcgtaccaattctttgtatgtctggtagaattcagctgaggaccatcgttgcaacgatggtcctcagctcaacgatggtcctcagctcaacgatggtcctcagctcaacgatggtcctcagctcaacgatggtcctcagctcaacgatggtcctcagctcaacgatggtcctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406602 - DNA, 2468 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406603 - DNA, 2546 bp, Homo sapiens
gggtcccctcctcaccggtcggctgcccggcccctgcctgcctgcacgcagcacacagcattgagcccatcctacacaaggcgccttaatttaaaaatactggaaaggttttactgttctagatattgagtgctaccagtgactctgcctgtttcactctccccaattaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406604 - DNA, 1672 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccgaggagagcttgcaggcctctgcgagttgccacccctccgaagttggtctgggtcagatgcggccgtggaccctctagaa

SEQ ID NO: 406605 - DNA, 1547 bp, Homo sapiens
  misc_feature (1504)..(1504): n is a, c, g, or t
  misc_feature (1528)..(1528): n is a, c, g, or t
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacaggccaaganccagatactgtgaacaggagactnctgtgtacagacccgccca

SEQ ID NO: 406606 - DNA, 2368 bp, Homo sapiens
agatattttcacctatgctaaagtattggcactgatcacggtcagcgtcgcaggcattgttatacttggcaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406607 - DNA, 2410 bp, Homo sapiens
agttcagtatcttataaacaaaaataagcgtcacccctctgacaaagtatgaaccagtcttctaaataaaattaatggcttctttaagaaaagcctcagccaccttgcagagatgacttgggaaatcttaaggaagaatgtgtctccttctggagacaccagacaaacaactctgaggcgatgattggctttccttggagtgaaatcaggaacatctctttcaatgacaaaaagtttgtcattaaacccatcgacaagaaggcacctgactttgtgtgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406608 - DNA, 2160 bp, Homo sapiens
tccaggtggccctgttctgttttgtaggactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406609 - DNA, 2008 bp, Homo sapiens
ccgtatgggagagatgaatggcaagaactgggccaagctgtgcaaggactgcaaggtggctgacggaaagcccgtgacagggaccgatgtggacatcgtcttctccaaagtcaaggggaagtctgctcgggtcatcaactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406610 - DNA, 3312 bp, Homo sapiens
gttgggggagaggtctggctcaagctgccacatcccactggaagcttctgggatgtctcatgatcctctgccaataccagctgtactactgaagtagacatccccaaagagatgggtttgactttgtacacgagtcagtgcagctgctggattcatagagggaggacctctgattgactttcacccactttgctccctccaccccgaactgttcagtgctgatctgacagcccccggtcaggaactggttttaaatctaattatatatgtgccccttgcaatggggtcgcagtgcctgaaacacgacctcctgcagctagtatatacagcgggcaccatggaaagatccagctccttggacgtctccaggctggagtgagagctgggctctgctgctcatcagctatttgggggctagtagcatcacttcttcaagcctcattttcctcattgtagaatgggggcaatacccaactcataaggttgctctgcagatgcgaggtcccatgcccaggacctagcacagaggtttagtcagctgtagctctcattgtgggacgcacacagagcttgtcgctccgtctgggatcccctgtgccctccaggaaggcacagcccctgagaagctctggggatggttcccactggagactgcacaccaggctttaagcagctcctctccttcacagacccgctggcgcgtccttcccccactgtggcttctccatctgtggaggtgccttctggggacgtgtctcccggctgtccagggctgctgctgcctagtacctccttgcctctgttccagcccccattcccgctgccgatctgtattaggctgttctcacaacggctataaagaacaagctgagactgggtagttaaagaaaagaggtttaattgactcacagtcccacatggctgggggaggcctcaggaaatttacaatcgtggcagaaggcgaaggggaagcaggcacctcttacatgagggcagaagagagaaaagcaaaggggggtaatgccaaacactgaaaccatcagctcttgctcagaacccacccactagcacgagaacagcataggggaaaccaccccgtaatccagtcacctcccaccaggtaatgccccccacccccagcatggggggattacaggtggagatgagatttgggtggggacacagccatatcaccatcccaagttgcaagcggaagactttggttcttaggtttttggagaaagtacctgttaagtgaggagagctggctacaaagcagatccacactaagctcaactctagggctggctgggatggaggcgggcgggactgggtgtgtgtgaagctgttggaaggactgcaagtggcgagcaggagagcacttgataatgactgtggcatgaagggaggctaggaacagagcccgttactcatgctaacaggattttttttctaaaaattatataatgtctagagttacaggtaaaaaaagaaatggtagttttaaaactgcccaggttccggcatcacagttcctcttcctgtcttggacgcagagggttgtaaaccccccatgcaccctgagggtgctcctcttcgaagccacagcccagcacagttcagtgctgccttagcctgccaggacagagggaggtgacagtctgttctcatagccaggaggataggacttctgggtgagaagtcctcttattaatttgctttccaaaggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406611 - DNA, 1676 bp, Homo sapiens
  misc_feature (80)..(81): n is a, c, g, or t
  misc_feature (88)..(88): n is a, c, g, or t
gcctgagagtctggagaaatcccctgccaagttgcccctctgaaagaggcgcgaaggcgcaagaagtataatttaaaganngccagcncggggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406612 - DNA, 1277 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcacagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406613 - DNA, 914 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagcttaaccccaacttttcttccgacccctaaaaaccccctctaatataaatactgattctacc

SEQ ID NO: 406614 - DNA, 871 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggagtggtaaacgtcataacaatgaaaaacaaaacagaagactggtccccagggcgttgggaagaggcttggtagcatacgc

SEQ ID NO: 406615 - DNA, 750 bp, Homo sapiens
ggacgtgaaatctttacttagagaaaagcgacagagtcagagacccacgggggcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaggtttgttccaaggtaaccggacccttggatttctacaggccaagtacactaggactaccagcaatctccggatcgacatat

SEQ ID NO: 406616 - DNA, 648 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtgtgcacacgccgagtaccctgacactcgctgacctgctgcagcctccccgggcacctcaggcatagaaaatgagctcagggatctgcccaacctg

SEQ ID NO: 406617 - DNA, 1349 bp, Homo sapiens
caaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaactttaaagagtggataattccattaaccaaccaaaaagaaaagtagtaagataaacattttcttcaaactctgaaaattatcctttttttttttgaaacccccactgtcctcccaagtcacagcaacaagttaaaaagatgatgggaggtggggaagagtggaggagcaggaggaattcttaacagtaagtttcggggtccagggcccgattggcatgtggccccattccaggtcactggggtcatttccaaatttgagttctccaggattgatagcatcatcccatgaggactggggcttagtgaggcagtagctttgatttccagctgagcacaagagtgtgatagtacttgtttgttttttgttgttgttgttttgagatggagtcttgctctgtcgcccaggctggggtgcagtggcacgatcttggctcaccacttttgactaacctttttttgtctggagtgctaaaaagatgactttaagaataaatatctcctgaaaactggcttgagggccccattgagtcttggttagaagcctgtgttggggacagtgggccttcgtcttccggatttgtgtggagagtgtggcttgtttcgtgcaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaagtgagtgctgtgccctgctgttgggatcttgccatctccgtgcgctccagcatgtcttttcctgtgactctagttagtgctttaaagggctctgtgtcaggccttgtgaagaccttgagggaaccgagttaaaagtggggttttcttagggaagaggt

SEQ ID NO: 406618 - DNA, 587 bp, Homo sapiens
  misc_feature (484)..(484): n is a, c, g, or t
  misc_feature (511)..(511): n is a, c, g, or t
agttcagtatcttataaacaaaaataagcgtcacccctctgacaaagtatgaaccagtcttctaaataaaattaatggcttctttaagaaaagcctcagccaccttgcagagatgacttgggaaatcttaaggaagaatgtgtctccttctggagacaccagacaaacaactctgaggcgatgattggctttccttggagtgaaatcaggaacatctctttcaatgacaaaaagtttgtcattaaacccatcgacaagaaggcacctgactttgtgtgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgagganccaggagacctgagcaagccagggganctgagcaagccaggggacctgagcaagccaggagacctgagctagccaggagacctgtgcatgccaggagacctgt

SEQ ID NO: 406619 - DNA, 298 bp, Homo sapiens
cagagcccacgggctacagcgcggagctgtctagtgagggcatccgggatgaccgcaatgaggagaagcgcatcactgaggcagagaagaacgagcgtgtgcagcggcagctgctgggtgaggcccaaggggctctgtctccagggagcctgcctcgcttttggagcagacaggcttggggagggcagtgatgtgagccagccccacccagcacccctcttgcccttcctgttttcctaggggacgggccgggccatatggggaggaagggactagaccaacgctgcttaatgttaca

SEQ ID NO: 406620 - DNA, 540 bp, Homo sapiens
cagccaaaagctgttgcccttttgagtgagtttctcatgagtgttgagcctctctctctctcacgcaggtggtaaagactatcggcctccgggaagtgtggtactttggcctccactatgtggataataaaggatttcctacctggctgaagctggataagaaggcaagtcaggattaactatttacaggctgtggattgggtgttggtctgcttcatcgataaggaaactggagcaactcaccctgtcttttgttttctgttcctttttgtttgtgtaaaagtttttacagacaaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaactttaaagagtggataattccat

SEQ ID NO: 406621 - DNA, 3081 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406622 - DNA, 3131 bp, Homo sapiens
ggacgtgaaatctttacttagagaaaagcgacagagtcagagacccacgggggcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406623 - DNA, 4081 bp, Homo sapiens
  misc_feature (3117)..(3117): n is a, c, g, or t
  misc_feature (3121)..(3121): n is a, c, g, or t
  misc_feature (3130)..(3130): n is a, c, g, or t
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagaaaaaaaaaaaaaaaaaaaaaaaaaaaaaaaaaaanaaanaaaaaaaanaaaaaaaaaaaaaaaaaaaaaaaaaaaaaaaaaaaaaaaaaaaaaaaaaaagttggccacggacacaacagagacaaaaaaacaaaaagaaaaagcaatcgagagggcgacggccaccaacaagagaactaagagagacagagcaaggggacgacgaaaggagaaaacgggagccaaacacagaggcggcgcacccacccaaagacaaaaaaacgacgggcgggcagacaaacaaggaggtagaggagacacaaaaaaacaaaaaaagaagcagagcaggagaacgacagtcagaggaggtacaataaacaaacagagggaggcgcacacagagagcacgcgagtcacatcatacttcttctaacccacacgccaggcgcgggacgaaaaaacaaacagaaagaaatataaaagacaacacgacaaaagggaggaagaagagaaagaaagagaaaacgagcaacacaagaaacaacaaacaaaaaaaaaagagacaaaaacaaagaagaaaagacacacaaacaacaacgaagagaaaaaacccagcaaaccacaaaacaaaaagaaaacaacaaagaacaaagagacaacaaaacaaaaaggaagaaaaagacaacgaggaaccaaacaaagcagacacagagagaaaaagaaacaagaaacatcagaacaaaaaaaaaaaaaaaaacagacaaaaaaaaaagcaaaaaagaaaaccacaaacaaaaaaacaaaccaagcgagggacgggagagagagaagcaggcacaacagcgcaagaggaagaacggacgaaagacagaaggaacgagagaaaagagacaaagaaagagcagaagagaaagaaaagacaacaagagacaagaaaaggaaagaaaaaaaaaagacacacacaaaaagaaagaagaagaaaaggaaaagaaagaagaccgggaggaggagacgcgacac

SEQ ID NO: 406624 - DNA, 3584 bp, Homo sapiens
  misc_feature (3117)..(3117): n is a, c, g, or t
  misc_feature (3121)..(3121): n is a, c, g, or t
  misc_feature (3130)..(3130): n is a, c, g, or t
  misc_feature (3584)..(3584): n is a, c, g, or t
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagaaaaaaaaaaaaaaaaaaaaaaaaaaaaaaaaaaanaaanaaaaaaaanaaaaaaacagggggcggcgcgcggcgataaaaaatactactccccggagagggggcgccgaaatttgacgagcatcccccaagttttcttggtgaacacagggggccgccctactagagggaggcgggcggataataaaagaggcaaagagaacggcggccgcgggctttataaaccaaaggtgtggagcgcgtggggaaaaaacgtgtgctgcatcggggagattttggggaaaagaggaccacttaatttcggggggggcgggagacatattttgtggggaacaacttcctacaaaggaaaattttagcaggcagagggggacaataatcaacactttgatggtgtattaatggttgtaaccccaacgcaatatatgttgggcgaagaaaaatttggcaaccggggtaatattataaggaaattttaatgcgagtgtatatattaaaaaggn

SEQ ID NO: 406625 - DNA, 2925 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406626 - DNA, 3093 bp, Homo sapiens
  misc_feature (253)..(253): n is a, c, g, or t
gagattgcgtggagcatacgctttggggcgcgtgcccggcgtccggtgatggtgaacagtggtcttcgctgttgtccttaagtagactccgtgttccgtgagatatcgtagcgtatgtgctcactcagaacaatcgaaaatgccgcggagcgaatcacagtgtcgctacgtgtaccacactctggatgcgagatctggaggtcagttactcgcgtgtctatctacaaggtggtacacaacgacggcatgctcngatctacggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406627 - DNA, 3568 bp, Homo sapiens
caaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaactttaaagagtggataattccattaaccaaccaaaaagaaaagtagtaagataaacattttcttcaaactctgaaaattatcctttttttttttgaaacccccactgtcctcccaagtcacagcaacaagttaaaaagatgatgggaggtggggaagagtggaggagcaggaggaattcttaacagtaagtttcggggtccagggcccgattggcatgtggccccattccaggtcactggggtcatttccaaatttgagttctccaggattgatagcatcatcccatgaggactggggcttagtgaggcagtagctttgatttccagctgagcacaagagtgtgatagtacttgtttgttttttgttgttgttgttttgagatggagtcttgctctgtcgcccaggctggggtgcagtggcacgatcttggctcaccacttttgactaacctttttttgtctggagtgctaaaaagatgactttaagaataaatatctcctgaaaactggcttgagggccccattgagtcttggttagaagcctgtgttggggacagtgggccttcgtcttccggatttgtgtggagagtgtggcttgtttcgtgcaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406628 - DNA, 3027 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406629 - DNA, 2708 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatataccaagttggataatactagatttgtcaccattaggttttaacaaaggggtaacgttttttgatctggtataatttttgttaacccttttaccagtaatcggtttaccactatgt

SEQ ID NO: 406630 - DNA, 2111 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406631 - DNA, 1756 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacaggtgtggttatgcatctgagtgtggcggacatactctcctccagtccaatcctgagcatcttcatcttattaattagcctgtacgtttctttgtgcactcattcttgtatatagactgctttacaatgtcagtggtatccagttgtttccagtagccagtttcttgaacttcggacctgtaacataactaagtgcagacctccagagtcacgtggcctttctgtgctctacattattatttgagggcccacatcagttgcc

SEQ ID NO: 406632 - DNA, 2595 bp, Homo sapiens
cagagattggccccatatcctgagctgacgtttccattctttggggaggtggccgggcagggacgggaggaaagatgaggcagaggtgaaagcacatggaacaccaccggggggactggctaaccttggcacacaagcagcacagcaggccccgggaaagggtgggggcaataaccctccctaatcctagctcagtgagtagagggagtgacctccctacccaggaagtcccccttttggttgccatggcccaggtcctgaccatccccctctgtacttccctgctccatctccccacccatgtaaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406633 - DNA, 2442 bp, Homo sapiens
atcaaaaagctcagttcgagcggccttagtatagccgttcatattcgcaagaatatgagttccatcgtgatggatgcggtccgttgcttcctgattgctcaggatctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406634 - DNA, 1454 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggagaagcatcagaagcagcaggagcagcaacagctggaaacagagaagaaaaggagagcaaccgtggagagagagaaagagcagatgatgcgcgagaaggaggagttaaccacgcatcagacatatgaggagtcgaagccgtctgaggt

SEQ ID NO: 406635 - DNA, 1910 bp, Homo sapiens
gggaatggaaagcgagggctcctaggtccctgggctgagggtttgaatggctctggctttgtgtctttgcagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406636 - DNA, 1240 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtgcactgctttctccttcacagctaagatgccatgtgcaggtggattccatgccgcagacatgaaataaaagctttgcaaaggcacgaag

SEQ ID NO: 406637 - DNA, 1633 bp, Homo sapiens
gggaatggaaagcgagggctcctaggtccctgggctgagggtttgaatggctctggctttgtgtctttgcagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccgagggcaacaccaagcagcgcatcgacgagttcgaggccctgtaacagccaggccaggaccaagggcagaggggtgctcatagcgggcgctgccagccccgccacgcttgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttagtttttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaag

SEQ ID NO: 406638 - DNA, 938 bp, Homo sapiens
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggccttgccatatgcaaatggcaaggccaaggtcagaagatgaaccacgtgacgaaatagaaaaagctacctatggagtgtgcccctacgcaggtacttggccttgccatatgcaa

SEQ ID NO: 406639 - DNA, 960 bp, Homo sapiens
  misc_feature (755)..(755): n is a, c, g, or t
ggcttttgggagcccgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtntggaagccaccgactcaggtagaaaagcaggaaagcacagacctataggatgcagcaggagccccacatgcacatccgagatgaaaccatctaggcagtgagggcagcatgtcctcactgcacagtcgagtaagcacagtcgagtaagactgctgccaatttctttctttttttttttacagatacaatcttctctgacattgat

SEQ ID NO: 406640 - DNA, 522 bp, Homo sapiens
agttcagtatcttataaacaaaaataagcgtcacccctctgacaaagtatgaaccagtcttctaaataaaattaatggcttctttaagaaaagcctcagccaccttgcagagatgacttgggaaatcttaaggaagaatgtgtctccttctggagacaccagacaaacaactctgaggcgatgattggctttccttggagtgaaatcaggaacatctctttcaatgacaaaaagtttgtcattaaacccatcgacaagaaggcacctgactttgtgtgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagggagagggagagcctgtttctaataaatatacaaaatc

SEQ ID NO: 406641 - DNA, 577 bp, Homo sapiens
atcaaaaagctcagttcgagcggccttagtatagccgttcatattcgcaagaatatgagttccatcgtgatggatgcggtccgttgcttcctgattgctcaggatctggaaatgtatggaatcaactatttcgagataaaaaacaagaaaggaacagacctttggcttggagttgatgcccttggactgaatatttatgagaaagatgataagattggctttccttggagtgaaatcaggaacatctctttcaatgacaaaaagtttgtcattaaacccatcgacaagaaggcacctgactttgtgttgtatgccccacgtctgagaatcaacaagcggatcctgcagctctgcatgggcaaccatgagttgtatatgcgccgcaggaacctgacacggagcactgcaggcgccgggttgggacagcgtcttcgctgctgctggatagtcgtgttttcggggatcgaggatactcaccagaaaccgaaaatgccgaaaccaatcaatgtccgagttaccacctgatcaaaaagctgttttccagttgtatttggctggattgcaaactccagctctg

SEQ ID NO: 406642 - DNA, 3735 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgccttaatagttattaaccaatgtgatggccgggtgtggggaccctcgcctgtaatcccagcactttgggaggccaaggagggaggattgcttgagaccaagagtttgagaccaacctggacaacatagtgagaccctgtctctacaaaaaaattttttaaaaattagccaggaatggtggcatgtgcc

SEQ ID NO: 406643 - DNA, 3453 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatcttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406644 - DNA, 2788 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagcacagtggttaatagcatgggctctggagtcacatggcctgggtgcaagtcctgtactagccacataatctggtacgagctgata

SEQ ID NO: 406645 - DNA, 2955 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctgtgagctaagcagcttcagatactgggagttcatgcttcggtagagacggcggtactgtaagtttaccagaaagttgcacatgtcccattgtggcagctgctccgggatgttgagggccttccgcacgtacgggttgttgaggtaggtggaagcagctgttgtgttggtgcagggggggtccatgcgcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaacgccttcacgagctgcaatctgtcc

SEQ ID NO: 406646 - DNA, 1789 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttg

SEQ ID NO: 406647 - DNA, 2212 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcctgatcgtgagacaggcgatggtgggcagaacataagggtgggtcagagcatgcggtag

SEQ ID NO: 406648 - DNA, 4367 bp, Homo sapiens
ctgcccgccagaccccgtcgcccggccggatcccctgagctgcccgccatcccacgtgaccgcgccgccccccagctccaccgctgagtgagttggggcgcgtccctatcccgttcccagtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctaggagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctgggtaaggcgcaggggcagacagggacggacgggagcggacggggttggggtcgccccaacagtgggcacgggagctaagtaagggtttctctgctgcttcagtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406649 - DNA, 1842 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgagggcagctctcatgccgggatcctgctatggatcgtctatatatacaggctt

SEQ ID NO: 406650 - DNA, 3487 bp, Homo sapiens
ggacaatggaagaattcattccacccactcccgcttccccaggcctggacttgaaaggggagcagacaaatttcctgtcgttgggggaagttccctcttcttggccctggatctgaccctgaggcctcctgtagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406651 - DNA, 3069 bp, Homo sapiens
cagggtggcaagggtgggcatgctctcactttgagaaggccctgactctggctcccacctcgcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406652 - DNA, 1633 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttg

SEQ ID NO: 406653 - DNA, 3274 bp, Homo sapiens
cggagactctctgtttgccaactcaaatactgtatcgcctaatgattcctggtatctactaccttccacgacttctgcagaaagttgaagatggtcattatcttctccatgtttgccatctggatcataagagtctgtatgaaccaatgcaattccattttggacacttgaagcactacaagctcctggaatatactctccctcagagtgattatgaagatttgtactgcttcctaaggtatccctgccttcctcactgtgatgtactgcaacaaaggattgactgctctcagtggtttgattcaatgctgaaccacaagtgggaatttctgtttcacttttttcaaatataggttcactgggtaaagaagaatcaaaccactgagagtctccgtcgaactagttcgacggagactctcagtcaggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406654 - DNA, 2946 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagctccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406655 - DNA, 1262 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaactggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttg

SEQ ID NO: 406656 - DNA, 1084 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagctccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttg

SEQ ID NO: 406657 - DNA, 1001 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccatctctgtcactgctagcgtccatgcctggtcccacagacagctgaggtccgctgtcagctgatttgcgccgtttcggccagaaggtccggggaggccggccgcgtgctggcgtcgattttcaccttgggggtgcggtcgacctaggcctcagcgggtgggtgcccgcgggcggggggcccccggctggggggggcggcccgggcccggggggaaggggccg

SEQ ID NO: 406658 - DNA, 1290 bp, Homo sapiens
ctgcccgccagaccccgtcgcccggccggatcccctgagctgcccgccatcccacgtgaccgcgccgccccccagctccaccgctgagtgagttggggcgcgtccctatcccgttcccagtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctaggagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccgaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttg

SEQ ID NO: 406659 - DNA, 217 bp, Homo sapiens
tattaacccccctggcagctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagtaagccccagccccaaccccagctcacccttttcgagcccca

SEQ ID NO: 406660 - DNA, 400 bp, Homo sapiens
aataataataactaacattaatgagcacctaactacacaccaggccctaagtgctttccacataaaactaatttgaccctcatgacaaccctgtgaaggatgtatcctcattttatgggtgggcctctgagcctggagaggttaagcaccttatcccacatcacacagccgtgagtgacttgagccccttcctgcagtgcgcagttctgtggacgagcttgttggcattgactattccctcatgaaggatcctgtggcttccaccagcaacctggacatggacttccgggtgagctgcttgggctggtgtatgacctctgacttcctaacaagacctctttctctgctaagttgcaagattttacttcttaaagcacagctctgatgaggccactcccat

SEQ ID NO: 406661 - DNA, 3651 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406662 - DNA, 3631 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagttgcacatgtcccattgtggcagctgctccgggatgttgagggccttccgcacgtacgggttgttgaggtaggtggaagcagctgttgtgttggtgcagggggggtccatgcgcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaacgccttcacgagctgcaatctgtcc

SEQ ID NO: 406663 - DNA, 3550 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctcttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406664 - DNA, 2757 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatcttctggttgagggaatccacaaaccactcatcccccatgaaattgcaggccatgtctacatctccattatataataggatctggtatttctgtgagctaagcagcttcagatactgggagttcatgcttcggtagagacggcggtactgtaagtttaccagaaagttgcacatgtcccattgtggcagctgctccgggatgttgagggccttccgcacgtacgggttgttgaggtaggtggaagcagctgttgtgttggtgcagggggggtccatgcgcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaacgccttcacgagctgcaatctgtcc

SEQ ID NO: 406665 - DNA, 2279 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctcc

SEQ ID NO: 406666 - DNA, 4266 bp, Homo sapiens
ctgcccgccagaccccgtcgcccggccggatcccctgagctgcccgccatcccacgtgaccgcgccgccccccagctccaccgctgagtgagttggggcgcgtccctatcccgttcccagtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctaggagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406667 - DNA, 3477 bp, Homo sapiens
ataaaggccaagccagtcatcataggcgggaccaggcagatgggcgtggccttgaaaatgtagagggggccaagaaggaagcaggaccagtggatgtgaggcgtggtcgaagaacaacagaaagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406668 - DNA, 3495 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406669 - DNA, 2991 bp, Homo sapiens
catgatagccgggtaatcggacaggctgccactccctctggacacgtgctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406670 - DNA, 1620 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgtctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttg

SEQ ID NO: 406671 - DNA, 1236 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggtacgggtcccagagtgggggctgctggctg

SEQ ID NO: 406672 - DNA, 2405 bp, Homo sapiens
ctgcccgccagaccccgtcgcccggccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgatccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406673 - DNA, 1844 bp, Homo sapiens
ttcgagctcggtacccaaggtatccagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcccttgatcgtgagaaaggcgatgtgggagaactcttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaggtagatatcattattatccccattttacagatggagaacctgaggctcatatttaagaaatttgcccaagattatgtggctagtacagggacttgcacccaggccatgtgactccagagcccatgctattaaccactgtgctggacagaacctagtcctaacttggccctgccagtgcttcctatatcaccttgtgcaaggtctcctcccaccctggacctctgctggcccatttttggcatgaatgaagctcttctcacccttaagactccgtggctgatgcagacccctaggcctcctatagcaggacagcatgggtggggacaaacccaggttcaaattctgaccccaccaatcacaggaccctgggcttcgcctttcggagtttcagcttcccttgtcctgacaggaagtctcaagggcccccagcttgctgtgctactctggggtcctaaggctgctggtgatccagctgtgctctccccactcacctgtgagctaagcagcttcagatactgggagttcatgcttcggtagagacggcggtactgtaagtttaccagaaagctgccgggaacatacgagcaggccccaggaagaccaggtcggggcgaaaagtagtcaacagatcagaccttctctcctatctccaagctccaacccagaaggcagacagctgggttccactcccctttttgggggggggccacctctctaggactgacttggatgttgggctggatgggctgggattcagacagcctcaactcaccaccatttagaaaggtacagggatgctgggcgtggtggctcacgcctgtaatcctagcactttgggagaccgaggtgagtggatcacgaggtcaggagttcgagaccagcctgaccaacatggtgaaaccccgtctctactaaaaaaa

SEQ ID NO: 406674 - DNA, 1158 bp, Homo sapiens
ctgcccgccagaccccgtcgcccggccggatcccctgagctgcccgccatcccacgtgaccgcgccgccccccagctccaccgctgagtgagttggggcgcgtccctatcccgttcccagtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctaggagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgatccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttg

SEQ ID NO: 406675 - DNA, 2348 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406676 - DNA, 2400 bp, Homo sapiens
ttagctaggcatggtggcacatgcctgtaatcccagctactcgggaggctgaggcaggagaattgcttgaacccgggaggcagaggttgcagccggctgagatggcgccatcacactccagcctgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406677 - DNA, 1069 bp, Homo sapiens
  misc_feature (17)..(17): n is a, c, g, or t
  misc_feature (131)..(132): n is a, c, g, or t
aatagggaatcctttcnccgttgcttgtttttgtcaggtttgtcagagatcagatggttgtacatgtgcggtcttatttctgagttctctattctgttccactggtctctgtgtctgtttttgtatcagtnncatgctgttttggttactgttgctttgtagtatagtttgaagtcaggtagcatgatgcctccagctttgttctttttgcttatgattgtcttggctattcgtgctctttttttttgtttcatatgaatttttttttttttaaagcgtgtgtgaacaaatggaaataaagcagggactgtgaacattgtttttggtctgttgaagatctctcataatttaattcttaattttgggaatagtgcttttatcaagtgctttttattcattaaataatggatttgcttctcagcaggtttgcaaggcaagcatttacattttacatattagaacactgaggtattctagtaccagagtgttgaaagtggtgccagagtgttgaaagagttgacgtggcttaggtcacagaatggagtagtggagtgaggcctccatttttgtagtttttgcatccttcctgtgagtcatgttttactcagcatcaaggaaacagtgatgagcaaagcagagatggttcctctcaagaggcaagggattgaaaggtcatgtggggaatcgacagtgccagtgagtgccaggctttctgcccctctttcctctctgcaggagttcgctccctgtctccacctaatgaattcctgctcagcctcaggatgtgttacttaaggttactgtgtcagggagccatccgtggcctgccacactcagtcaagtcctgtggtaccctctcgttttcctttgtacctcttctccacctcatataccacggttggaatgtgtgtgattactgaactagcttcaatagggcaggggtttagtcttttatgctcatctttatgttaacagctaggtgtacagaccaatctatgacacgtagttgggttattgaatgtttgcatgagtggcttacaaacagcttaaatattggcaggtgggttga

SEQ ID NO: 406678 - DNA, 3101 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaacattgtttttggtctgttgaagatctctcataatttaattcttaattttgggaatagtgcttttatcaagtgctttttattcattaaataatggatttgcttctcagcaggtttgcaaggcaagcatttacattttacatattagaacactgaggtattctagtaccagagtgttgaaagtggtgccagagtgttgaaagagttgacgtggcttaggtcacagaatggagtagtggagtgaggcctccatttttgtagtttttgcatccttcctgtgagtcatgttttactcagcatcaaggaaacagtgatgagcaaagcagagatggttcctctcaagaggcaagggattgaaaggtcatgtggggaatcgacagtgccagtgagtgccaggctttctgcccctctttcctctctgcaggagttcgctccctgtctccacctaatgaattcctgctcagcctcaggatgtgttacttaaggttactgtgtcagggagccatccgtggcctgccacactcagtcaagtcctgtggtaccctctcgttttcctttgtacctcttctccacctcatataccacggttggaatgtgtgtgattactgaactagcttcaatagggcaggggtttagtcttttatgctcatctttatgttaacagctaggtgtacagaccaatctatgacacgtagttgggttattgaatgtttgcatgagtggcttacaaacagcttaaatattggcaggtgggttga

SEQ ID NO: 406679 - DNA, 3491 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgtttgtggtggtctgcgcaacacagaggcacatttctccaagtattggcatgggctatctcgtggttcgtgacaggtcctacggactactttttacagccgtatagagagccccacggggtttacagtcgccccgtttctaaatcctcgaatgtaaggggggctcatcgggtgatggaggttgacaatgctggctatactctaactctcaagctctgtttttcactctattaaaacacgcccggtgtgtgtgtcaaacccacacgcggtgggaacaaccaccacgaccgccccgccggcggccaaccttgtgcgcacacccatctttaccaacaccagacagcaccacacacccgcagacacgacaacgaaaacacaacaccagacaacccaaacaaagacggaggggggacgcccgcgactcgctcagcaggaacgatacccccacgccgcagcgcgcggggccacaccaacacaacgcaccaacaacgcaacacccgacaaccaaccacacgcgagcacatatcacaggcgaccaacaaacgacgacggctgtggccccacaagacatgacgcgaggaggcagagcgccacagacaacaagagcaaccggacagagaaagaccatacagagcgaagagcagtacgctatggaccagcgaagacgcggcgggcacggcagaacgaggggagaacaacagcagccgaagaagacagggaaggcggaagacgacactgtgagagacggaccaggacaccagaacgacgtaagacaagcgcggcgaggcgcaggaccaagcaccacaaaaagcggggcgagccgaagacaccagcccacctcccgcaggcgcggcaaccagaccaaccgacgccccacaccacgaaggcagcagactcacagacacacacaccccgcacggcagggctgcaaatcaatcgagcgctccaccacacacccggaccgcgcgacaagctcaccacagtgcgcaccgccgcgaacacaaagcggcccgcgcgccgacacgaccgcagagacgaccgcgaccgcaacagagcgaagagaacgcttgaacaacatcacagaagagccaagccggaagcgagaagcgacgacagaagcgagaagagacagagccacgaacgacgacggcagacgccgacacccgcaggggaaacgcaaggaagagcagcccggagcgcaagcggcaagaaccgacagagcggaagagcacgacgcacgagacagacgcagcgaggcagcccgcacagcaccgcaagacagacacaccaaccgacgaggaagcgagagcgcaccggaacaggcgagcacgcacgg

SEQ ID NO: 406680 - DNA, 1859 bp, Homo sapiens
ggcaggacgaggctgggttgaatccaaccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406681 - DNA, 1812 bp, Homo sapiens
cgagctcggttccccttttgggtctttgctcttttggggtctttgctccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406682 - DNA, 1633 bp, Homo sapiens
gcacggctgatttcatagggactatcaatttcaatgttcttggctccttcaggcagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406683 - DNA, 1167 bp, Homo sapiens
tagaggatcctcagcttacagcgttcgggggaaggagcaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406684 - DNA, 1745 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406685 - DNA, 1564 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406686 - DNA, 1232 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406687 - DNA, 623 bp, Homo sapiens
taggatccccattggatacccggatatagggaaggacgagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406688 - DNA, 619 bp, Homo sapiens
agaggatccccgctcacaacattgcacatggtcaagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406689 - DNA, 1058 bp, Homo sapiens
actagactgctgcagactcgtagaccttctgcaggcccgtttcactcaccattaggcagggcacaactgctccgagtttcagccactcctcacactggcctgctgtgctctctagggaatcccggttgtgtgttttggggttctgctgttctcaagcccatcagttgccctgtttcttctctctgcgttctccttcacagacactgataacgtgaaggtcttgtggctgtcggtgttttgacccccatccctgtctctgtgttgtggggttcagtagagatactttgttgcctggttttgttgtaaacatggtccgtgggtttttggttttgctgtctacttgctctgtctttatgtgagcccctgtacttctttctctcctgcccatttgatccgttttccacatcattgcttatgcttgcttgatccttcaggtgaccagtatgcactgaagatgaggtttgtggaccatgtgtttgatgaacaagtgatagattctctgactgtgaagatcatcctgcctgaaggagccaagaacattgaaattgatagtccctatgaaatcagaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406690 - DNA, 899 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatactttttaaagtacattatgagaacaaccagccatcctaggttatagaaaaaatacgtgataacagcagtgagaataaatgacctatatggatttcagtcttcaccatgattcatactcctcatacctttataaactttagaattttattttcctttattgaagtacaagccctcacg

SEQ ID NO: 406691 - DNA, 1021 bp, Homo sapiens
gggaaggccaacttttactttctcaatctgagcaaaattcactgttttaaggagcaaaacgagcagaattattggacaggaagaatggtaggagagagtagagacctaggcaagggccgctcctgtaaaaattaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406692 - DNA, 732 bp, Homo sapiens
ggcacgagcgtgtctttcttgagcttgccagccaccaggcgctcagcctccaccgccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaacaaaaaaaattattatttattttttttgtcgttcttaatataaccttgtttctcatctcgcacttctatttctcatacaaaaaaaaactttttggccgctttggcccatgcgtttttaatctgatttttttttgggggcccaatttgggctattttggcaatccccttattgggggggtttaactacgggcgccgtttagttggtttg

SEQ ID NO: 406693 - DNA, 2554 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaacaaaaaaaattattatttattttttttgtcgttcttaatataaccttgtttctcatctcgcacttctatttctcatacaaaaaaaaactttttggccgctttggcccatgcgtttttaatctgatttttttttgggggcccaatttgggctattttggcaatccccttattgggggggtttaactacgggcgccgtttagttggtttg

SEQ ID NO: 406694 - DNA, 2353 bp, Homo sapiens
gccaggagacacctagcaactccgcagcggccatcttttacaagaaaccttcgctgcaaccgctgcgtcacatcaccgcgtctcccagggacaggaaagcctctccgtgtttggtgaagcttcaggggaagcagtcatcctgtcgtcgcatacggcaaaatcctccattgccgtagccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406695 - DNA, 2463 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgtttaaaaatcatttctcaccaaacacacccgttaaaaaaacgataagaacgcaaacattccctcatgtgctctattgccgacacttgcggtagaccatgcgctttagcatgcttatggtcttatacgctttcaagtctcagaatcactttttggggttgtgaggccggatattactcagtttcccaaaattaaataacgctatgcatttcggcgctattcggacaaatcccctatattggacgataatccatgtccggtcgccggattttactctggtgtccaccggataccgtggcgtcccatac

SEQ ID NO: 406696 - DNA, 1637 bp, Homo sapiens
gtacgagggctgggggtgaatcggccgagggaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406697 - DNA, 1772 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406698 - DNA, 1017 bp, Homo sapiens
ccacgcgtccgcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406699 - DNA, 971 bp, Homo sapiens
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttctaatgctgcccagatagccggatatattgtaac

SEQ ID NO: 406700 - DNA, 526 bp, Homo sapiens
ggcacgagcgtgtctttcttgagcttgccagccaccaggcgctcagcctccaccgccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaggatatttttcagcctataaagccccctgttttatgcccttctaattctgatgtttgggtattgtgtgagtgcatgtgtttttttttttttttttaaagcgtgtgtgaacaaatggaaataaagcagggactgtgaaca

SEQ ID NO: 406701 - DNA, 806 bp, Homo sapiens
  misc_feature (752)..(752): n is a, c, g, or t
  misc_feature (772)..(772): n is a, c, g, or t
  misc_feature (799)..(799): n is a, c, g, or t
agcggaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatactttttaaagtacattatgagaacaaccangcccttttccttgacccttnaacccagccttgaaccccgaagttcantttgaaa

SEQ ID NO: 406702 - DNA, 372 bp, Homo sapiens
ttggactcacaacgctgtcgtagagctactggtctaaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaaaggtgaagccacggcccagcaggatctccttgttgaactgcgaccaggacacagaacggtgctggaaggcctccatactgaggctgttgtcattgaagatcttctgggccaggaagaggaagtgctctgggagcagcccccggttggtccccac

SEQ ID NO: 406703 - DNA, 663 bp, Homo sapiens
  misc_feature (568)..(568): n is a, c, g, or t
ctcatctttgccttctagccctccagcttcctctctcttctaggctctttcctcctagcttactaaacccgccttttttccagtctcttccatcctcttccttagttctctctactttccttttccacctctcctccttcaagtctcctcccaccttcccccacttcttaggatgatcagatttgcccctggaagggatcctaacaacacagtgcgatggttaatccccactcagattcaaagcctgctttccaaacacacatacagagctctctgagggtgatggggctgagcaggaggggggctgggtaagagcacaggttagggcatggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgccctcctatcccccagcctgggccagatgagcctgccctttgaccagcctnacccccagggcctgctgccgtgccagcctcaagagcatgctgtgtccagccctgaccccctgctctgctcagatgtgaccatggggggagaccgc

SEQ ID NO: 406704 - DNA, 549 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgagcatatatcagagggaccccctgaagctggtggccactttcagacaaatacttcaaggagagaaggtttgcacaatgtggttcatggtgaccagcggcgatcgggttaccgggatggttctcagtgagccc

SEQ ID NO: 406705 - DNA, 195 bp, Homo sapiens
cctcatcctgatcttcctgcagggagttcctggtcggctccgacgccttctgctgcaacttggctagtgccctactttcagacactgtccagcaccttcaggctcgagatagggagtactgctagaggacagtcagtttgtatatctgcatgatgcgtgatgacactcactgtatagacatctttacactgattc

SEQ ID NO: 406706 - DNA, 544 bp, Homo sapiens
cagagtgagatactatctaaaaaaaaaaaaaaaaaaaaaaaaggaaagaaagaaagaaaagaaacccctgtcctcaccctcttcaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggtgagtccccaccctgggtagtctgagcagccatacaccagtcacctccatactcactgccca

SEQ ID NO: 406707 - DNA, 4768 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaggggagaaggagcaggtccagtgttcccaggcccccaattctgggggcaaatgttgccacttttagctggaccttcccagggaagtccccctttcccccttgtccaaactgagtccaactgctcacaccactggtgcaaacctaaagagaatgggagtgtgttgtgtgagggaggggaaaaccccagatgccctggaggcagagtccttgccccctcgctctgggcaggggtgagggcaccacgcaccctccttgtgtcctctctccaggcctctgcttgttattgcttgaagccccacagtcttatgcccatggagcaggtggggaggcaggagaagggcagaggaaggatccagggttgtgactagattccggggatggagagcgtgggggtctgtgtgagccagaagtctgaggtcctgggtctgaagacaccagtccaaccctcactgccggctggcctcagcctccactttcacgctgctcctgcgaccctccaccagcgcgggatggggtcct

SEQ ID NO: 406708 - DNA, 4703 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaggggagaaggagcagggaagtccccctttcccccttgtccaaactgagtccaactgctcacaccactggtgcaaacctaaagagaatgggagtgtgttgtgtgagggaggggaaaaccccagatgccctggaggcagagtccttgccccctcgctctgggcaggggtgagggcaccacgcaccctccttgtgtcctctctccaggcctctgcttgttattgcttgaagccccacagtcttatgcccatggagcaggtggggaggcaggagaagggcagaggaaggatccagggttgtgactagattccggggatggagagcgtgggggtctgtgtgagccagaagtctgaggtcctgggtctgaagacaccagtccaaccctcactgccggctggcctcagcctccactttcacgctgctcctgcgaccctccaccagcgcgggatggggtcct

SEQ ID NO: 406709 - DNA, 4714 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaggggagaaggagcaggtccagtgttcccaggcccccaattctgggggcaaatgttgccacttttagctggaccttcccagggaagtccccctttcccccttgtccaaactgagtccaactgctcacaccactggtgcaaacctaaagagaatgggagtgtgttgtgtgagggaggggaaaaccccagatgccctggaggcagagtccttgccccctcgctctgggcaggggtgagggcaccacgcaccctccttgtgtcctctctccaggcctctgcttgttattgcttgaagccccacagtcttatgcccatggagcaggtggggaggcaggagaagggcagaggaaggatccagggttgtgactagattccggggatggagagcgtgggggtctgtgtgagccagaagtctgaggtcctgggtctgaagacaccagtccaaccctcactgccggctggcctcagcctccactttcacgctgctcctgcgaccctccaccagcgcgggatggggtcct

SEQ ID NO: 406710 - DNA, 3937 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagttggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406711 - DNA, 3578 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgac

SEQ ID NO: 406712 - DNA, 4340 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctccctgctccccgctgccctcctctccctgcccgtgtgtcatcctgatgtcactccctatttcatagctgtgcttctcttacttccccatgatccatgcccaccttttccacctcccttcctccctaaccccagagcactccatggctgtcttttccttctcacaacagctgaacagatgggtaaggatggcaggggttatgtcccagctaccatcaagatgaccgtggaaaggtgagtgtggtggtatggacagtgggtaggtcaggggcttagtgcttatctgcaggaaggaggggtggcatcaacccttggtcagtcacatgtacctccttccctcctccagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406713 - DNA, 4339 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggtgaggccaccccagccagtcctctgtctctgtgcctgtgccctctggggtttcttctgggaatgaaatgtcctgaccttcctgatgccgatcctgatcttcaggaagttcttccagcttctcttcttccttctgtggtctaaatgttcaccttctcactgtgagctctgtgggaacggagactagtgggtctctctccctcaggagccccaccctaggtcctctctcccttgccttggtggagtgagaacaggtcttatggtaggggttggggaaggggaagaaagtccggacagagggatctcagggtctccttcctaccataggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406714 - DNA, 2593 bp, Homo sapiens
ccgatcccctggaacatgctgccaagcatggctgggacatcaacaaggatgcctgccctgtatgcagccccaattgggctcccttcaggcacggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406715 - DNA, 2431 bp, Homo sapiens
cttcgggcactctagcaggatcttgaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406716 - DNA, 4415 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggtgaggccaccccagccagtcctctgtctctgtgcctgtgccctctggggtttcttctgggaatgaaatgtcctgaccttcctgatgccgatcctgatcttcaggaagttcttccagcttctcttcttccttctgtggtctaaatgttcaccttctcactgtgagctctgtgggaacggagactagtgggtctctctccctcaggagccccaccctaggtcctctctcccttgccttggtggagtgagaacaggtcttatggtaggggttggggaaggggaagaaagtccggacagagggatctcagggtctccttcctaccataggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctccctgctccccgctgccctcctctccctgcccgtgtgtcatcctgatgtcactccctatttcatagctgtgcttctcttacttccccatgatccatgcccaccttttccacctcccttcctccctaaccccagagcactccatggctgtcttttccttctcacaacagctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406717 - DNA, 3958 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggagtatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406718 - DNA, 3486 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggcagaagcaggaagcaaggagcaggtggcactctcaaagtgggtaatttgagcagtttcatcaagagatgagtgtagaggtgtgagcagatgcaacggattagctgccaggagggacagcaacaagacctc

SEQ ID NO: 406719 - DNA, 2451 bp, Homo sapiens
gttatctatgaggatccccgaacatgtcgaggcttcgagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctccctgctccccgctgccctcctctccctgcccgtgtgtcatcctgatgtcactccctatttcatagctgtgcttctcttacttccccatgatccatgcccaccttttccacctcccttcctccctaaccccagagcactccatggctgtcttttccttctcacaacagctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406720 - DNA, 1789 bp, Homo sapiens
aagcaggctggtaccggtctggggtttatggaggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406721 - DNA, 2741 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406722 - DNA, 1680 bp, Homo sapiens
gtctcagagcctgaacttcccttccagtcagtgctggaaggaggtgggcaggggaatgatagaaaggaaggagtggattggctccacccactgtgcattctcctgttagccttttcctcctgacccaggagtaggtggggataggagggcaccctccccatctgctgcttggcagggcatgagcaagtgtccagagcaggtctgtgggggtagtagaagagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406723 - DNA, 3238 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttgccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406724 - DNA, 3773 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaggggagaaggagcaggtccagtgttcccaggcccccaattctgggggcaaatgttgccacttttagctggaccttcccagggaagtccccctttcccccttgtccaaactgagtccaactgctcacaccactggtgcaaacctaaagagaatgggagtgtgttgtgtgagggaggggaaaaccccagatgccctggaggcagagtccttgccccctcgctctgggcaggggtgagggcaccacgcaccctccttgtgtcctctctccaggcctctgcttgttattgcttgaagccccacagtcttatgcccatggagcaggtggggaggcaggagaagggcagaggaaggatccagggttgtgactagattccggggatggagagcgtgggggtctgtgtgagccagaagtctgaggtcctgggtctgaagacaccagtccaaccctcactgccggctggcctcagcctccactttcacgctgctcctgcgaccctccaccagcgcgggatggggtcct

SEQ ID NO: 406725 - DNA, 1276 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406726 - DNA, 716 bp, Homo sapiens
ttctgaccagacttgatggttttaagtcggaaccgataaattttaaaaaggagaaaaaataatttgacctagtagtataaaacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406727 - DNA, 2645 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggaagtaagtgaaaaacctcatggggataccatcccactctaagggggtgggcatttgaattgttagaagaggctcttctgtgagaaaggagcagcaaatgctaacagcctgtcttcttctcttctgtccactctaatgagggggtagtagttaagatctggactgcctaggtttgaattctagctcc

SEQ ID NO: 406728 - DNA, 2642 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctccctgctccccgctgccctcctctccctgcccgtgtgtcatcctgatgtcactccctatttcatagctgtgcttctcttacttccccatgatccatgcccaccttttccacctcccttcctccctaaccccagagcactccatggctgtcttttccttctcacaacagctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgtaaggagctggaaagacaggaatgggagtggtctgtgcagatgggctaatcttagcatg

SEQ ID NO: 406729 - DNA, 1377 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaacactgaaaatattcctcctctggtgctccatgaaggactcattagtttccggggggagggagcgggggag

SEQ ID NO: 406730 - DNA, 1010 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggttgggctagggctgatggggaagagggg

SEQ ID NO: 406731 - DNA, 265 bp, Homo sapiens
ccctgcagaagggggctgaggctggccaaggtgggggccagggtggttctggggagtgtgtaggagtggttgcctcttggatctcaaccttatctgaacctctaatctgtctgcacccttgatttctgcccccaaccctcagtgtctctgcacagcttgatagaaactcctgctaatgggactgggccaagtgaggtgagtaatgggctgacaggtggagaccttggtcaaagtgcagctggagggatggaagctagacctcaga

SEQ ID NO: 406732 - DNA, 3969 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattcca

SEQ ID NO: 406733 - DNA, 4013 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406734 - DNA, 4692 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagttggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaggggagaaggagcaggtccagtgttcccaggcccccaattctgggggcaaatgttgccacttttagctggaccttcccagggaagtccccctttcccccttgtccaaactgagtccaactgctcacaccactggtgcaaacctaaagagaatgggagtgtgttgtgtgagggaggggaaaaccccagatgccctggaggcagagtccttgccccctcgctctgggcaggggtgagggcaccacgcaccctccttgtgtcctctctccaggcctctgcttgttattgcttgaagccccacagtcttatgcccatggagcaggtggggaggcaggagaagggcagaggaaggatccagggttgtgactagattccggggatggagagcgtgggggtctgtgtgagccagaagtctgaggtcctgggtctgaagacaccagtccaaccctcactgccggctggcctcagcctccactttcacgctgctcctgcgaccctccaccagcgcgggatggggtcct

SEQ ID NO: 406735 - DNA, 4122 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaaaaaaaaacacacccccgggccttcggggggaaaaggccaacagcacggcaccgtcccgcccctctggcaaggagaaacggcccaaagagataacgcctgtacaaacaca

SEQ ID NO: 406736 - DNA, 3959 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406737 - DNA, 4228 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctccctgctccccgctgccctcctctccctgcccgtgtgtcatcctgatgtcactccctatttcatagctgtgcttctcttacttccccatgatccatgcccaccttttccacctcccttcctccctaaccccagagcactccatggctgtcttttccttctcacaacagctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406738 - DNA, 4415 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgacaaaaaaaaaaaaaaaaaaaaaaaaaaaaaaaaaaaaaaaaaaaaaaaaaaaaaaaaaaaaaaaaaaaaaaaaaaaaggggggggggggtaaaaatatttttttggggggggcatattgcacccgtttttttttgaaaagggggggcctaaggggggtgtttttatattaaaccacaagggcggaccggcgcgcctgtatcataaccaaaccgcctctgtgtgcgggagcacaacacgacctgtacttgtcgcggaatctactcttctgagaaagacaaccaccaccctcatgcaggccgggcgggccacaaccatgtctggcgcgacccaccctcccaccaggacgaatatattctaaccgcgccctccggacgcctaatcaaacaagcacctccgggcttcatccatgttggcctcacccccccgccgcactatcttgctcctgggcgcctgccaaaactgtgcctcaccgtgcttttttttcatcagcacacccttttttcagcgcggggcctcagccgaacaaaaacaccccccccgatcagaccatacgcttccaccaaagcagaccagacaggatagtcgtaagccgcccaagaaggagccgacggcgacgtagaaacgcgacagataacgacacaaacgcgtaggttaggtcacgtattacgaccagcacaccacccccgctctaaccgatacgcatagagagcagcgatcttccagcacgtgccgtacccggctagccgaccagtacagacacatcataacgtacctgatcagcactatagtacacacatcattcagccgacctcctgcatcccgcaagcctcggcgcca

SEQ ID NO: 406739 - DNA, 2559 bp, Homo sapiens
tcactgtacaactggctaagctactgtactttgtaattctccaagaggggagccacggtgtggtgttgtacctcatttgaaatggtcggattggcgaccatttcaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406740 - DNA, 2334 bp, Homo sapiens
accgaactaacaacaataggcttagtaggagcccccggttattcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406741 - DNA, 2300 bp, Homo sapiens
gtgggttgaccgtggcttgtgggttgaccgtggcttgtgggttgaccgtggcttgtgggttgaccgtggcttgtgggttgaccgtggcttgtgggttgacgagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406742 - DNA, 2403 bp, Homo sapiens
tagcttggctgaaggagtgagaacaggtcttatggtaggggttggggaaggggaagaaagtccggacagagggatctcagggtctccttcctaccataggctctccacagtgaggccaccccagccagtcctctgtctctgtgcctgtgccctctggggtttcttctgggaatgaaatgtcctgaccttcctgatgccgatcctgatcttcaggaagttcttccagcttctcttcttccttctgtggtctaaatgttcaccttctcactgtgagctctgtgggaacggagactagtgggtctctctccctcaggagccccaccctaggtcctctctcccttgccttggtggagtgagaacaggtcttatggtaggggttggggaaggggaagaaagtccggacagagggatctcagggtctccttcctaccataggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406743 - DNA, 2010 bp, Homo sapiens
tccacgttttctgctacctggaaccgagagtctcttctccttcaagtccgtggttctggtggagcccgactgagcactaaggatcctctgcccaccatcgccccacagagcgagcgtcggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406744 - DNA, 1750 bp, Homo sapiens
gctggtacggtccgagtggtatggatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406745 - DNA, 3125 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaa

SEQ ID NO: 406746 - DNA, 2583 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcttctgatacgtgtatgagactatgcaaaagtacaagggctgagattcttcgtgtatagctgtgtgaacgtgtatgtacctaggatatgttaaatatatagctggcaccttagttgcatgac

SEQ ID NO: 406747 - DNA, 2690 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgac

SEQ ID NO: 406748 - DNA, 1214 bp, Homo sapiens
tccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattccttaccgtctaagggatcgtctagagcg

SEQ ID NO: 406749 - DNA, 2085 bp, Homo sapiens
gcccccgggccccagcctcggggacccccgccccttcccctagttcccgccccgctcccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406750 - DNA, 417 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaagacctgacagccacttgtttgtttcatctttcctgagaactaagagaggttcacccagctcagttcttctcaaagacaccccgtctgtgcattgtgcttgtttgctcatccatgaaaagaggaagagagaacagccgtggatgtgatgtcagtatcaaaacttccttgaggacaggcgggataaattgggcaaacggctgagttctcccgcagcctttgggagattggccctgagaacccagaatagatgcccattatacatcatg

SEQ ID NO: 406751 - DNA, 2541 bp, Homo sapiens
  misc_feature (2541)..(2541): n is a, c, g, or t
gcccccgggccccagcctcggggacccccgccccttcccctagttcccgccccgctcccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaagggaaaaaaaaaaaaaaaaaaaaaaaaaaaaaaaaaaaaaaaaaaaaaaacaaacaaacaacaacagggggggggcgcagcataaaaaagatacgccggggggggccaacaaatatgagcgcagtcaacccagcattttgtcgtgtagcacaggggggtgccaaagtaagagcctgcgagttattatatagagcagcaaggcgacgggcgccggtgttttaaacaaagcgttgtgtgaggtggggaaaaaatggtcgtgacggtggagcaatttttgggaaagagaacacatattgttgggggggggaaacaatatggggggcaaccacacacagagagagatttaagcctgagaggaaatataacatttgaggtgttatgtgagaaaccaggtcaattattggcggatgaaaatttgctcacgattgtgtttgaaacatatacgaggttatataaaggn

SEQ ID NO: 406752 - DNA, 3464 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaacccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406753 - DNA, 3096 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406754 - DNA, 3570 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacggttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaagtaggacatcctgtggagagcccaggacccgggagacgccctgggaggaggtggcagggatgggggcgatggggggtcagagcggtctaggggtgaccagggtggggtgcggagccccaggctggaggctcagtctctgtgccccgtgcagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406755 - DNA, 3572 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaacccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaaggtaaggaggggaccaggtgtgggggacctggagtggtcccaaggctgccatcctggatctgccacccgcccaactgagagagcccactctgtcctctcccctgcctagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406756 - DNA, 2142 bp, Homo sapiens
cgggggaacctggatgggcacagtgaagccaggccttggagggcgggagaagatgggagaggaaatggggaaccccattggtgctgtaacagagacacaacttggcagaaactggcaggactgcggaatcgcgggatcaggaagcgcgtaggcactcccggggcgtgctgggcaggtgctgctggagagagagctggccgagctgagcgccgagctggacaaggacctgcgggcaattgagacccgactgccgtcccccaagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406757 - DNA, 2193 bp, Homo sapiens
gcccccgggccccagcctcggggacccccgccccttcccctagttcccgccccgctcccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaaggtaaggaggggaccaggtgtgggggacctggagtggtcccaaggctgccatcctggatctgccacccgcccaactgagagagcccactctgtcctctcccctgcctagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406758 - DNA, 2053 bp, Homo sapiens
gcccccgggccccagcctcggggacccccgccccttcccctagttcccgccccgctcccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccggaccctagtgcctctaacggagggggcagcccagccaggagggaagagaagaaggtaaggaggggaccaggtgtgggggacctggagtggtcccaaggctgccatcctggatctgccacccgcccaactgagagagcccactctgtcctctcccctgcctagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406759 - DNA, 1080 bp, Homo sapiens
gcccccgggccccagcctcggggacccccgccccttcccctagttcccgccccgctcccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagacccgggatgggatcctgctagagtcgccgagcag

SEQ ID NO: 406760 - DNA, 2344 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaacccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgcgagccactctgggaggaatgtggggggagcttgtagttcctggctcagtcttttctcaggggagcggccctcgagtgtctcgctaaaacaatgattgattctaaggtctcatatgtcccctttatcaatatatcaaactttattttgagatgggggaacactccgggatcctcaagagcgatcta

SEQ ID NO: 406761 - DNA, 627 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaagacctgacagccacttgtttgtttcatctttcctgagaactaagagaggttcacccagctcagttcttctcaaagacaccccgtctgtgcattgtgcttgtttgctcatccatgaaaagaggaagagagaacagccgtggatgtgatgagcaggaatcaacagaggacccaggagaaagggatggagcccagggcatgaaacatagtccagattcctgctggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagctttcacatgtgatgtttcaaggcaacggggagagcttctttaccagaacgagggagaagataagactaaagcagtaatggtggtagggactgaaaatcact

SEQ ID NO: 406762 - DNA, 456 bp, Homo sapiens
tatcacaactttcaggctttagaaagaaaatgtaattttgatacagtagatgaataatttaatggtaaatgaagcagactttttaatgttgatgctattaaggcgaaggttcatcatagaattcaaggaggtgggaagacaaggttcttctttgtttggaggccagagccgtactttatggtatccactgggccaacagatcagccctcttatcctacccatcgcagtctacctgagctgggaaagaaggctgatgcagacctaatttcccagctcctgggtctgtgccctcctttgtggctgagttgacttggcttggttttccctctgaggtcatcacttacttatccttcccttataaaatctactttctagacctgacagccacttgtttgtttcatctttcctgagaactaagagaggttcacccagctcagttcttctcaaagacacccc

SEQ ID NO: 406763 - DNA, 287 bp, Homo sapiens
tgccagtgcctgccctaggtgggggtgcaaccccatcccccaggtatggcctccccaagctgaggttgtgcttctccacagaccctagtgcctctaacggagggggcagcccagccaggagggaagagaagaaggtaaggaggggaccaggtgtgggggacctggagtggtcccaaggctgccatcctggatctgccacccgcccaactgagagagcccactctgtcctctcccctgcctagagaaaggccgccaggctcaagtttgacttccaggcgcagtccccc

SEQ ID NO: 406764 - DNA, 2924 bp, Homo sapiens
  misc_feature (3)..(4): n is a, c, g, or t
  misc_feature (8)..(9): n is a, c, g, or t
  misc_feature (12)..(12): n is a, c, g, or t
cgnncgcnnggncaggcagcagccgggcagggatgctcctgcgctcccgggcggcctcgggcccagccacctgctcgccggggaagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406765 - DNA, 3615 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaagtaggacatcctgtggagagcccaggacccgggagacgccctgggaggaggtggcagggatgggggcgatggggggtcagagcggtctaggggtgaccagggtggggtgcggagccccaggctggaggctcagtctctgtgccccgtgcagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406766 - DNA, 3514 bp, Homo sapiens
ccttgcccaggcagaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaagtaggacatcctgtggagagcccaggacccgggagacgccctgggaggagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406767 - DNA, 2557 bp, Homo sapiens
gcccccgggccccagcctcggggacccccgccccttcccctagttcccgccccgctcccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaagtaggacatcctgtggagagcccaggacccgggagacgccctgggaggaggtggcagggatgggggcgatggggggtcagagcggtctaggggtgaccagggtggggtgcggagccccaggctggaggctcagtctctgtgccccgtgcagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406768 - DNA, 2614 bp, Homo sapiens
cgggggaacctggatgggcacagtgaagccaggccttggagggcgggagaagatgggagaggaaatggggaaccccattggtgctgtaacagagacacaacttggcagaaactggcaggactgcggaatcgcgggatcaggaagcgcgtaggcactcccggggcgtgctgggcaggtgctgctggagagagagctggccgagctgagcgccgagctggacaaggacctgcgggcaattgagacccgactgccgtcccccaagagctcgccggcgccccgacgggccccggagcagcggcccccggccgggtgagtgggagacgcgggaggaggaagggggctgtcccaggccgggcgggagggaacgtggcgcggccgggcggggcggacgggggcgatcgcggggcccagccgggggaggaaggaaccgcagagccgtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaagtaggacatcctgtggagagcccaggacccgggagacgccctgggaggaggtggcagggatgggggcgatggggggtcagagcggtctaggggtgaccagggtggggtgcggagccccaggctggaggctcagtctctgtgccccgtgcagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406769 - DNA, 2114 bp, Homo sapiens
ctggacccttgagaagctccgagggcctgattcggcgaagacccatagcagaggctggcaggaagcagcgtggggtcgatctttgaccgctgcctcccacccccacggtgcgctgcccctcactgcccagcctctccccgcccccaggtgctgctggagagagagctggccgagctgagcgccgagctggacaaggacctgcgggcaattgagacccgactgccgtcccccaagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccaccgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406770 - DNA, 947 bp, Homo sapiens
ctgcccacgaagtggcggtgcacgatggctggtttgtggacaagaagaaaaagtaccacttttgtattaggagccacaagcgctttgagaggaatgggcgagacctgtgccctttccggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406771 - DNA, 898 bp, Homo sapiens
ctcccagcaccccagcttgctggctgccctctttgcccacccaggagcctagaccccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccacccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 406772 - DNA, 4745 bp, Homo sapiens
gggaagggtcgggggcgaggccgcgtcgccgcctccccgaagccttttcctgttgggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggatgactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406773 - DNA, 4230 bp, Homo sapiens
aggtaaccaggtgtcctcagcatattctgccgatggtggggtccacaccacactttggggacccctgtgcaggcagcccaggaccaggtggacgtggggacccagacggacgtggggaccacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggatgactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406774 - DNA, 4612 bp, Homo sapiens
gggaagggtcgggggcgaggccgcgtcgccgcctccccgaagccttttcctgttgggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggatgactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406775 - DNA, 3251 bp, Homo sapiens
gggaagggtcgggggcgaggccgcgtcgccgcctccccgaagccttttcctgttgggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggatgactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406776 - DNA, 2505 bp, Homo sapiens
gggaagggtcgggggcgaggccgcgtcgccgcctccccgaagccttttcctgttgggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggatgactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406777 - DNA, 1210 bp, Homo sapiens
actcacggcccgtctcgccccagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406778 - DNA, 331 bp, Homo sapiens
tgggtagatacggggtttcactatgttggccaggctggtctcaaactcctgacctcaagtgatccacctgcctcggcctcccaaagtgctgggattacagacgtgagccaccgcgcccggccactcctcctgtttttccgctgccgattgttgtgcagggtcctctgcatgcccagctgggccatggggccttgctgagagagatgggggtggggaggaaaggaggagctggggagactgagtcccatccgaggatagggttggaactggcctcctggctcccacacccacagcaagaggcggagtccaacctgcgcaaggccaagcaggg

SEQ ID NO: 406779 - DNA, 836 bp, Homo sapiens
  misc_feature (712)..(712): n is a, c, g, or t
  misc_feature (718)..(718): n is a, c, g, or t
  misc_feature (728)..(728): n is a, c, g, or t
gttagtacgagcccgggtgtgtaatcggccgaggctctggcggactcgttaccagtccatggaaagcctgtatggaccgggcagtgagggcacgcctcccagcctggatgactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaagcggagnagctanggcactacgnactggtggcgagcgaagaaccgagcagagtgaggtacccggacggcgcgggaaccgaggcccgcaaggacaccaagtgggtgtccctccaaggttaaggcggcggacc

SEQ ID NO: 406780 - DNA, 4548 bp, Homo sapiens
ggcgtactgatatcgtcgatcccagcgcgcttcgcccttaccgtgggcggcgacggcagatttcacagtcatgagagggcggggaccccggtcattcatgctcgacggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggatgactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406781 - DNA, 4821 bp, Homo sapiens
gggaagggtcgggggcgaggccgcgtcgccgcctccccgaagccttttcctgttgggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggatgactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcggcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggtgagtcccggcatatggagtggagggcgcggggtcccgggagccgctcagcacctggcccctgcccaccccgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406782 - DNA, 2047 bp, Homo sapiens
caccaacacctgctgacccttgactctgcgcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406783 - DNA, 2182 bp, Homo sapiens
cccgtttcccatcccggtgctgcctgcagccacaagctccacgctggcccggtgtccacagcctgcccgagctgccactgcactccgccgcgaggtcaattccccgcttcagattttcttttctgggagttgtagtttcgctcctgctgcccaggctgaagtgcaatggggcgatctcagcccaccacaacctccgcttcccaggttcaagcgattctcctgcctcagtctcccgcgtagctgggactacaggcgccggccaccacacccggctaatttttgtatttttaacagagatggggtttcactttgttggccaggctggtctccaactgctgacctcaagtgatccgcaccccccttggcctcctgaagtgctgggattacaggtgtgagccactgcacgcggcgtctcgtattctttcaatccatcttccctgggtgtttaggggctgcggtttctcgggtttgctcttggctgaggacagaccgcctgggcaacagcgggtgtcagtagctgttacgggctgtgtgggtgggtttgttaatttataacatggaaaatggagccccggcccctctatgacttccgttctgcacttgcaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacgctgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcgggcggaaaaaaaaaaaaaaaaaaaaaaaaaaaaaaaaaaaaaaaaaaaaaaaagggggggcgcggcgccctaaaaatactccccccggggggcccccattttccgctcccccccattttttttttcaaggggggcccccatagagggggggccgaattattataagacgcaggcagcgcgcgggcggagcgcgtgtgttaaacacgcgtggtgggagagtgtcgggaaaaagactcttgttccagccgtgggggacccttggtgaggaggggaaacccacatatgtcgtggggggcgggagacacttggtgtgggaacaacaatcccgagagggaaaatttaaacgccctcaggggggacaatttaacaaatgtttgaagggtttagtactggggttaaaaccaaggcggcataatttgggcgcggccttaaaaaagttttgtgtgcgcggggaataatattataagacaatttttttcgcggggctgtgtataaatata

SEQ ID NO: 406784 - DNA, 693 bp, Homo sapiens
gaggagggaggggaggagggaggcagatctacaagtctagtgaagcccacaccttctttgccttaaacagaattctgttttccacagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgtgagtgcttgccaggctcacactgttgagagcagctttatggttgaatgtggcagtgtgttctgcaggagtcttctgtgagattagtgctactcttgccattttacaccactaaggaaactgtcactgactctagtctttggagtctgagccaagaagtctttttcttctaacctgggccatagagactctatggagaatgatgggaggtgatctacacagactcctccctcactgggttgatagctctgttgggaagatgttaacatccatcaggggaaaaaaccacgagagacagctcaagctagggaggcagagggttagcagcaaatgctaccccttctgagaactcagacattccagactcagagaccccatgagaagtttctgactcaggactgtgtaggcagtgctgcatgcatatgcctgccagggctcaatcagta

SEQ ID NO: 406785 - DNA, 2919 bp, Homo sapiens
tgagatggagtttcgctcttgttgcccaggctggaagttgtttttgttggaaacactctttgtcaagtacctgggggtcttcatcagtaagacctcattttagatgcctcctggcctccccttcccaggagcacagctatgaccttaggtactccttccgaaaagaacttgtttaactaaaggtaagtgtacctcatcctcaccatggcctccttccactggggaagcagatagcgcagaaaaaagaacacacccattccccacataccttcacactcgtcacatacctgctacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggccttttttttttttttttttgtaggatggagttttgctcttgttgcccaagctggagtgcaatggtgcgatcttcgcttactgcaacctctgcttcctgggttcaagtgattcccctgcctcagcctcccgagtagcagggattacagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 406786 - DNA, 2731 bp, Homo sapiens
aggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtacaaagcactgggaatacaaccttgaacaagacaagaatcctggccttcaaggaacttcgaaccttttgggggatatgataagacacattaggaatcaccatgttaatggttatctttcttgaaggatataagtccagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 406787 - DNA, 2293 bp, Homo sapiens
gaggagggaggggaggagggaggcagatctacaagtctagtgaagcccacaccttctttgccttaaacagaattctgttttccacagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 406788 - DNA, 2867 bp, Homo sapiens
tgagatggagtttcgctcttgttgcccaggctggaagttgtttttgttggaaacactctttgtcaagtacctgggggtcttcatcagtaagacctcattttagatgcctcctggcctccccttcccaggagcacagctatgaccttaggtactccttccgaaaagaacttgtttaactaaaggtaagtgtacctcatcctcaccatggcctccttccactggggaagcagatagcgcagaaaaaagaacacacccattccccacataccttcacactcgtcacatacctgctacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggccttttttttttttttttttgtaggatggagttttgctcttgttgcccaagctggagtgcaatggtgcgatcttcgcttactgcaacctctgcttcctgggttcaagtgattcccctgcctcagcctcccgagtagcagggattacagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 406789 - DNA, 2438 bp, Homo sapiens
tgagatggagtttcgctcttgttgcccaggctggaagttgtttttgttggaaacactctttgtcaagtacctgggggtcttcatcagtaagacctcattttagatgcctcctggcctccccttcccaggagcacagctatgaccttaggtactccttccgaaaagaacttgtttaactaaaggtaagtgtacctcatcctcaccatggcctccttccactggggaagcagatagcgcagaaaaaagaacacacccattccccacataccttcacactcgtcacatacctgctacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggccttttttttttttttttttgtaggatggagttttgctcttgttgcccaagctggagtgcaatggtgcgatcttcgcttactgcaacctctgcttcctgggttcaagtgattcccctgcctcagcctcccgagtagcagggattacagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 406790 - DNA, 2836 bp, Homo sapiens
tgagatggagtttcgctcttgttgcccaggctggaagttgtttttgttggaaacactctttgtcaagtacctgggggtcttcatcagtaagacctcattttagatgcctcctggcctccccttcccaggagcacagctatgaccttaggtactccttccgaaaagaacttgtttaactaaaggtaagtgtacctcatcctcaccatggcctccttccactggggaagcagatagcgcagaaaaaagaacacacccattccccacataccttcacactcgtcacatacctgctacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggccttttttttttttttttttgtaggatggagttttgctcttgttgcccaagctggagtgcaatggtgcgatcttcgcttactgcaacctctgcttcctgggttcaagtgattcccctgcctcagcctcccgagtagcagggattacagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgta

SEQ ID NO: 406791 - DNA, 2450 bp, Homo sapiens
tgagatggagtttcgctcttgttgcccaggctggaagttgtttttgttggaaacactctttgtcaagtacctgggggtcttcatcagtaagacctcattttagatgcctcctggcctccccttcccaggagcacagctatgaccttaggtactccttccgaaaagaacttgtttaactaaaggtaagtgtacctcatcctcaccatggcctccttccactggggaagcagatagcgcagaaaaaagaacacacccattccccacataccttcacactcgtcacatacctgctacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggccttttttttttttttttttgtaggatggagttttgctcttgttgcccaagctggagtgcaatggtgcgatcttcgcttactgcaacctctgcttcctgggttcaagtgattcccctgcctcagcctcccgagtagcagggattacagatggagcctcgctctgtcacccaggctggagtgcagtggcacaatctcgggtcactgcaacctccgccccccagcttcaagcgattctcctgtctcagcctcccgagtagctaggattacaggtgcacgccaccaggcctggctaatttttatatttttagtagagatgggattttgccttgttggccaggctggtctcaaactcctgacctcaggtgacccatccaccttggcctcccaaagtgctgggactacaggtgtgagccaccatgcctggtcccccacttgttgattttgcagaaaagatagctgtgttacaacctgtcctaaggtcaggtatgaatacttgtgcttctttcttggctccccaagccagagggcattcctatgcccaggtgagagagcacggagtgttactttggcagcacagtcagttaccagaggtaggaaaagcaaaggccaggcaggacatgaggggcccttgcactggctggttctccctgccttcaccaccctccaggtgaatgactgggtgaataatgattgactgaggaggtaatgaataatttatggacactgctggacctcagtctcctcatctgaaagatgagtggttggagaagtttaatggttttcaaatgctttttttttcagtcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcaccccaggccctctccccatgctgctgatggtcagctttctctgcacgctcgtggttgccacagtcaacgctgataaaattgctgatgcagattgcctgcccagctgcgagtgctggcacgggaccagcagcccagacggtcactggaagtggttgggctgattattggcatcatctccattgtcctactcggttcttaaaggcatatggacttgcctcactcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgttt

SEQ ID NO: 406792 - DNA, 2404 bp, Homo sapiens
tgagatggagtttcgctcttgttgcccaggctggaagttgtttttgttggaaacactctttgtcaagtacctgggggtcttcatcagtaagacctcattttagatgcctcctggcctccccttcccaggagcacagctatgaccttaggtactccttccgaaaagaacttgtttaactaaaggtaagtgtacctcatcctcaccatggcctccttccactggggaagcagatagcgcagaaaaaagaacacacccattccccacataccttcacactcgtcacatacctgctacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggccttttttttttttttttttgtaggatggagttttgctcttgttgcccaagctggagtgcaatggtgcgatcttcgcttactgcaacctctgcttcctgggttcaagtgattcccctgcctcagcctcccgagtagcagggattacagatggagcctcgctctgtcacccaggctggagtgcagtggcacaatctcgggtcactgcaacctccgccccccagcttcaagcgattctcctgtctcagcctcccgagtagctaggattacaggtgcacgccaccaggcctggctaatttttatatttttagtagagatgggattttgccttgttggccaggctggtctcaaactcctgacctcaggtgacccatccaccttggcctcccaaagtgctgggactacaggtgtgagccaccatgcctggtcccccacttgttgattttgcagaaaagatagctgtgttacaacctgtcctaaggtcaggtatgaatacttgtgcttctttcttggctccccaagccagagggcattcctatgcccaggtgagagagcacggagtgttactttggcagcacagtcagttaccagaggtaggaaaagcaaaggccaggcaggacatgaggggcccttgcactggctggttctccctgccttcaccaccctccaggtgaatgactgggtgaataatgattgactgaggaggtaatgaataatttatggacactgctggacctcagtctcctcatctgaaagatgagtggttggagaagtttaatggttttcaaatgctttttttttcagtcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcaccccaggccctctccccatgctgctgatggtcagctttctctgcacgctcgtggttgccacagtcaacgctgataaaattgctgatgcagattgcctgcccagctgcgagtgctggcacgggaccagcagcccagacggtcactggaagtggttgggctgattattggcatcattcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgttt

SEQ ID NO: 406793 - DNA, 1796 bp, Homo sapiens
tgagatggagtttcgctcttgttgcccaggctggaagttgtttttgttggaaacactctttgtcaagtacctgggggtcttcatcagtaagacctcattttagatgcctcctggcctccccttcccaggagcacagctatgaccttaggtactccttccgaaaagaacttgtttaactaaaggtaagtgtacctcatcctcaccatggcctccttccactggggaagcagatagcgcagaaaaaagaacacacccattccccacataccttcacactcgtcacatacctgctacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggccttttttttttttttttttgtaggatggagttttgctcttgttgcccaagctggagtgcaatggtgcgatcttcgcttactgcaacctctgcttcctgggttcaagtgattcccctgcctcagcctcccgagtagcagggattacagtcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcaccccaggccctctccccatgctgctgatggtcagctttctctgcacgctcgtggttgccacagtcaacgctgataaaattgctgatgcagattgcctgcccagctgcgagtgctggcacgggaccagcagcccagacggtcactggaagtggttgggctgattattggcatcatctccattgtcctactcggttcttaaaggcatatggacttgcctcactcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgttt

SEQ ID NO: 406794 - DNA, 1319 bp, Homo sapiens
tgagatggagtttcgctcttgttgcccaggctggaagttgtttttgttggaaacactctttgtcaagtacctgggggtcttcatcagtaagacctcattttagatgcctcctggcctccccttcccaggagcacagctatgaccttaggtactccttccgaaaagaacttgtttaactaaaggtaagtgtacctcatcctcaccatggcctccttccactggggaagcagatagcgcagaaaaaagaacacacccattccccacataccttcacactcgtcacatacctgctacgtgagatgtgcaaagctgaattcagggaatgctcagtagttacataacagtgccactaaaggcaattgttttcagtgatttccatcgagctgggttctgcaaagatccacagcactttccggttgcatgctgggcacttttggaagctgcagtcaattctggaggccaccagggcaccattagcacatagcagcaattattgactaaatggtgctctggttccatgccttccaagggggcccacttagaggcagggtggagttgcttagggccttttttttttttttttttgtaggatggagttttgctcttgttgcccaagctggagtgcaatggtgcgatcttcgcttactgcaacctctgcttcctgggttcaagtgattcccctgcctcagcctcccgagtagcagggattacagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgtgagtgcttgccaggctcacactgttgagagcagctttatggttgaatgtggcagtgtgttctgcaggagtcttctgtgagattagtgctactcttgccattttacaccactaaggaaactgtcactgactctagtctttggagtctgagccaagaagtctttttcttctaacctgggccatagagactctatggagaatgatgggaggtgatctacacagactcctccctcactgggttgatagctctgttgggaagatgttaacatccatcaggggaaaaaaccacgagagacagctcaagctagggaggcagagggttagcagcaaatgctaccccttctgagaactcagacattccagactcagagaccccatgagaagtttctgactcaggactgtgtaggcagtgctgcatgcatatgcctgccagggctcaatcagta

SEQ ID NO: 406795 - DNA, 839 bp, Homo sapiens
aggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtacaaagcactgggaatacaaccttgaacaagacaagaatcctggccttcaaggaacttcgaaccttttgggggatatgataagacacattaggaatcaccatgttaatggttatctttcttgaaggatataagtccaggtgcttggggagacccgtaagtggttagagggaagctgcaaggaagagtatctaggaggtaactaggtgaagaattttcttcagggggaaagaaatccatgcataaagtcttggtgccttcaagaaattgaaagacatttagtgtggctgtaggacaggcaggaaagagaatttggaaagagcctgctggctgcagatggagatggcccctatggtttgaagttttaagctgagtctctgcaatggaaagacctttgtctttcctgtgtccggtgtgggggagtggactcttctgggtgagtcaccaccaaatg

SEQ ID NO: 406796 - DNA, 2591 bp, Homo sapiens
aggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 406797 - DNA, 857 bp, Homo sapiens
gctctaatattcctctagtttcctttgtcacccaaaggatgtcctcatgattttggaagtcatggtcaaaaaactggtgtttgagttttcttttctgatcttctacccatttccccttttcttgccaaaaatcgtgtttcatcactggtcatttataacaaagttataagattacattatatctacagtattatgagattaaaaactttgctttaattagcaagaacgtgcaaaaagcaatcccacattctcattgccctgctagttctgcattctttcacagttcagcaaaactatctgaaatagtttctgggacatgagccaactcttcagccttagcttgttcattatattccttaagaagacttggaagactaattagttgaaccaaaagaagaatgtgctatgatatgagcaaaacaaatagaatgtcttaatgagagatgcttaaaatttcactttgtgaaacttttcctccctcataaaattttgttctatttttagttaatacatcaattcccaatgtcacagaagtaaaggagaacatgacatttggatcaactttagtcaccaacccaaatggaggatttctggtaagaatggagagaatgatatttattgacaacagatatgctatcattttaagtctttgtaagatctgttatataattttcagtctaatgatttctaattttaaaacaattttttaaaggcttgtgggcccttatatgcctatagatgtggacatttgcattacacaactggaatctgttctgacgtcagccccacatttcaagtcgtgaattccattgcccctgtacaaggtacagattttatgcaatgttcttgcatgttga

SEQ ID NO: 406798 - DNA, 582 bp, Homo sapiens
ggtaggctctctgcttagtttacataacattaaattactaatagcatgattattatctgattatgagtgttattgtcaattatcttaaaatcagtcataaaacaactcatataaactgtttctcaatgttcaaaaatgtttactgatttatttaacttccagggtgcttattggttctccgttagttggccaacccaaaaacagaactggagatgtctataagtgtccagttgggagaggtgaatcattaccttgcgtaaagttggatctaccaggtatgtaaaattaaaaaaatctggttttaggccaggtgcggtgagtcacgcctgtaatccccacactttaagaggtcaagacaggcatatcgtttgagcccaggagtttgagaccagcctgggcaacctgacgaaacctcatctctacaaaatatacaaaaatagctggatggggtggtgcactactgtagtcccagctactcaagaggatgaagtgtgaggatcgcttgagctcaggagtttgagactgcagtgaatggtaattgcgccactgcactccagcctgggtgacagagtgagaccctgt

SEQ ID NO: 406799 - DNA, 378 bp, Homo sapiens
agctttcgatggtaaccttaaccatgccttccataactcaaaacatgatggactcttagttaactctatgtaactggattttgtttttctcctaaagttgttctacgctgctgcgtatcattcaatgttgatgtgaaaaattcaatgactttcagcggcccggtggaagacatgtttggatatactgttcaacaatatgaaaatgaagaaggaaaatggtaagccagtgggttttgttgttgttatttacttatttcacaaggtaatgagaaatattatttgactacagtttcttttatgaatgaaactttaacagaatgaattatttatggtagaaaatgcagtctagtcatttggcaatggaagctaacttaaagt

SEQ ID NO: 406800 - DNA, 375 bp, Homo sapiens
ggtaggctctctgcttagtttacataacattaaattactaatagcatgattattatctgattatgagtgttattgtcaattatcttaaaatcagtcataaaacaactcatataaactgtttctcaatgttcaaaaatgtttactgatttatttaacttccagggtgcttattggttctccgttagttggccaacccaaaaacagaactggagatgtctataagtgtccagttgggagaggtgaatcattaccttgcgtaaagttggatctaccaggtatgtaaaattaaaaaaatctggttttaggccaggttgcagtgagccaagatcgtgccactgcacttcagcctgggcaacaagagcaaaactctgcctt

SEQ ID NO: 406801 - DNA, 2369 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgacagggatggaagagaaaacttaggaagttgaagttggcattaaaataaaggactcgccaccactctgtgcaccttcttgagggagttcattcgtccggagcgcctcacagcttagtgcgcctgcgcacgcgcgaactgcggccccgctctcctttggggacgggagacgtgcgtcgggtcgcgggacgggggctgcgcatgcgccttcatttcgtcagcccgctgttgcgtgctgccagcgggaactgtgtaggggtagattttcgctgcagtgttccccgagcctgttagacgcagcgcgccgggagactgagagaggaaaggatagaggaagtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcaccctggccaagaagcagtgggatagtgtggtactggagcgcatcgagcaggcctgtgacccagcctggagcgctgatgtggcggctgtggtcatgcaggaaggcctcgcccatatctgcttagtcactcccagcatgaccctcactcgggccaaggtggaggtgaacatccctaggaaaaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacatgtttcaacaagcagtgaagaccgacaacaaactgctcctggaaaaccggtccaaatttcttcaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtact

SEQ ID NO: 406802 - DNA, 8268 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406803 - DNA, 7322 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaataaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406804 - DNA, 2938 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgacagggatggaagagaaaacttaggaagttgaagttggcattaaaataaaggactcgccaccactctgtgcaccttcttgagggagttcattcgtccggagcgcctcacagcttagtgcgcctgcgcacgcgcgaactgcggccccgctctcctttggggacgggagacgtgcgtcgggtcgcgggacgggggctgcgcatgcgccttcatttcgtcagcccgctgttgcgtgctgccagcgggaactgtgtaggggtagattttcgctgcagtgttccccgagcctgttagacgcagcgcgccgggagactgagagaggaaaggatagaggaagtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcaccctggccaagaagcagtgggatagtgtggtactggagcgcatcgagcaggcctgtgacccagcctggagcgctgatgtggcggctgtggtcatgcaggaaggcctcgcccatatctgcttagtcactcccagcatgaccctcactcgggccaaggtggaggtgaacatccctaggaaaaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacatgtttcaacaagcagtgaagaccgacaacaaactgctcctggaaaaccggtccaaatttcttcaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaaaaagcttttgctatcttatcctgtttacattatttctttattttaattctgcttggtgttcttgcattgcatttaatgatcccttttctccccacctccacacactacattttttttagatttaaatagttttactattttaaatgattgccgtacaattagtagacttgaagacaagttttaaatatttttcttcaaaggcttgttaaaccaatcatgttaaaaggaaattcttggttttggtttgttgttgttagcattagtcatatttgatttagagggtaacttaaatcagttatttttagctttttagaactttgatctgctagggattgtcaaaataatctccttgaggcatctttatttttaaaatgagattaaagtatgtgatttgcttgttatgtgg

SEQ ID NO: 406805 - DNA, 3451 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgacagggatggaagagaaaacttaggaagttgaagttggcattaaaataaaggactcgccaccactctgtgcaccttcttgagggagttcattcgtccggagcgcctcacagcttagtgcgcctgcgcacgcgcgaactgcggccccgctctcctttggggacgggagacgtgcgtcgggtcgcgggacgggggctgcgcatgcgccttcatttcgtcagcccgctgttgcgtgctgccagcgggaactgtgtaggggtagattttcgctgcagtgttccccgagcctgttagacgcagcgcgccgggagactgagagaggaaaggatagaggaagtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcaccctggccaagaagcagtgggatagtgtggtactggagcgcatcgagcaggcctgtgacccagcctggagcgctgatgtggcggctgtggtcatgcaggaaggcctcgcccatatctgcttagtcactcccagcatgaccctcactcgggccaaggtggaggtgaacatccctaggaaaaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacatgtttcaacaagcagtgaagaccgacaacaaactgctcctggaaaaccggtccaaatttcttcaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaaaaagcttttgctatcttatcctgtttacattatttctttattttaattctgcttggtgttcttgcattgcatttaatgatcccttttctccccacctccacacactacattttttttagatttaaatagttttactattttaaatgattgccgtacaattagtagacttgaagacaagttttaaatatttttcttcaaaggcttgttaaaccaatcatgttaaaaggaaattcttggttttggtttgttgttgttagcattagtcatatttgatttagagggtaacttaaatcagttatttttagctttttagaactttgatctgctagggattgtcaaaataatctccttgaggcatctttatttttaaaatgagattaaagtatgtgatttgcttgttatgtggctaattagtggcaaagctggaagtcattcccagtctggactttagttctttgcgccaaaacatgctatattatttatttatttttttgcttgtcaaagttatacttaattctgttttatatttgtatgtggcattaatttgggtttgcacatttttattggactattttagttgtgaagaagcctgttctaaagtttaagtcacatgactagtatgtggcagttgacttaaactccaatactctttactatcattgacttaaactctgatactctttactataattatggaattgtgcaaatacctctgagtttaaaatattatttttattatttttggtgcacattcctaaaagttaaggaaggagcctcagtaatggaattgcttcttgaccttttgcaaacctcaatttagcaaaataattaggaacgatctaatagtgatgatacagtttttaactgctggatcagcgacgcctatttcaagtagtgatactaactaaactttcgccgg

SEQ ID NO: 406806 - DNA, 4936 bp, Homo sapiens
tcgagccggaccagcaggctgggcccagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406807 - DNA, 8296 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctaatgcaaactgcagaccccatatctttgaggatcctttcagtatcaactctggaaagaaaatgactacatcaactgaccatctgactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406808 - DNA, 3902 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatctaaatactggggcccaagcctggctggccccagattaagatgtcaatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagaatcctgacatcttaatctggcccagcctctggc

SEQ ID NO: 406809 - DNA, 1135 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtact

SEQ ID NO: 406810 - DNA, 4017 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagatgcaaacctggtgacccgcttttttggaggatcctttgacggtgtgctctgggataggacgtgactacctcaactgaccatgttaaaacgatgctcaattctgtgctgcgatacatgcgagattggtgccctccatggaaactcacttgttctgagatcagccaggtgattgttgcgatttattttggggaacccactttgttagagaacatttttgcgcgttaatcttactataaggggcgaacttgcgggtgaagtgatctatttgtttagctgccccattaaaatgacactcggtttttaatatgaagattggtttgccgggcacagtgtccgtggggccctccgctagttgttggttcggtccgcgtgcgcgctcgccgtccgacacttcgtacaatcgctcttttccaacgccgtaatatatgtggtaactagtttttcgtgagatatagtgtactgtggccggtcgttttggttgcgtcgactttggaagaagt

SEQ ID NO: 406811 - DNA, 478 bp, Homo sapiens
taaaattcagtaggtatgaattttatcccacaccaattgttattgaaagcaatgaatatttttatcatctttactttttcgaaaactattttttattgctaaaacaatgtgtctactttggagaacatcagttcatcttttaaaatgaacttctttcagccatgaaagcacttcatatgcctctgaaaaaaatagattccaaatttgacaattgactccttttattgcagaatgcagcactcaactggacatagtcatagtgctggatggttccaacagtatttacccatgggacagtgttacagcttttttaaatgaccttcttgaaagaatggatattggtcctaaacagacacaggtatgtgactttgtgttttgatttctgttgttctaaagataaaaatgcacaaatttttaataaaaccaaatattctgaaagcaaattaatcaataaaactaaagttgagaatgaatttta

SEQ ID NO: 406812 - DNA, 8343 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406813 - DNA, 8289 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406814 - DNA, 8233 bp, Homo sapiens
gctctaatattcctctagtttcctttgtcacccaaaggatgtcctcatgattttggaagtcatggtcaaaaaactggtgtttgagttttcttttctgatcttctacccatttccccttttcttgccaaaaatcgtgtttcatcactggtcatttataacaaagttataagattacattatatctacagtattatgagattaaaaactttgctttaattagcaagaacgtgcaaaaagcaatcccacattctcattgccctgctagttctgcattctttcacagttcagcaaaactatctgaaatagtttctgggacatgagccaactcttcagccttagcttgttcattatattccttaagaagacttggaagactaattagttgaaccaaaagaagaatgtgctatgatatgagcaaaacaaatagaatgtcttaatgagagatgcttaaaatttcactttgtgaaacttttcctccctcataaaattttgttctatttttagttaatacatcaattcccaatgtcacagaagtaaaggagaacatgacatttggatcaactttagtcaccaacccaaatggaggatttctggtaagaatggagagaatgatatttattgacaacagatatgctatcattttaagtctttgtaagatctgttatataattttcagtctaatgatttctaattttaaaacaattttttaaaggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406815 - DNA, 8299 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406816 - DNA, 8315 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctttaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406817 - DNA, 4920 bp, Homo sapiens
cgattcccactcagctgggcgctagattacaatgtcttgacctggcaaaacctgcgtcatggtacgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttacgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctcggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaggagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttcaaactaatttccaaagaatttagctgaagactcagagtcagcctacctcttgactctccacatccgcatctaagatcctgaaggccaaaggaatgtgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattattaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatattacatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaagccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgaaaaaaaaaaaaaaaaaaaaaaaaaaaaaaaaacaaattcgatcaaagaaaaacaacaaacgaggagggggcgccgcgcctcaaaagaaaattccccgcgaagggggccaccatcattatcagcgccgccagccgcagatttgtgtgagaaagagggggctcccacctaagggaagggcccggtatcaaacaagagcagccgccgcgggccgtgtctaaaaacgaccagtcagcagggtgcgaaaacagcgtccagtgcgggcgacacccgttgaaaggaaggaacaccccatcctggggggcggagaacaatggggcacaaactgccgg

SEQ ID NO: 406818 - DNA, 775 bp, Homo sapiens
cggccgctccaacatcaaagtgtatgtggcgctggatagcccaggatttgtgagggagcagttctgcgactacatgtttcaacaagcagtgaagaccgacaacaaactgctcctggaaaaccggtccaaatttcttcaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtact

SEQ ID NO: 406819 - DNA, 1259 bp, Homo sapiens
acccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggcattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgcgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaaggtggaaagctaattacccatgctctcacttcatctgcctgctaagatg

SEQ ID NO: 406820 - DNA, 1969 bp, Homo sapiens
tctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagaccggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctccccgccctttcttagagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgccttttttttcttactgttttattacaaacttacaaaaatatgtataaccctgttttatacaaactagtttcgtaataaaactttttcctttttttaaaatgaaaaaaaaaagc

SEQ ID NO: 406821 - DNA, 2020 bp, Homo sapiens
tctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctccccgccctttcttagagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgccttttttttcttactgttttattacaaacttacaaaaatatgtataaccctgttttatacaaactagtttcgtaataaaactttttcctttttttaaaatgaaaaaaaaaagc

SEQ ID NO: 406822 - DNA, 1369 bp, Homo sapiens
tagtttcagcactggcctctgaaaatggccttgcccaggtctccaaggagtgaagggtagtagtgaggtgcagagatactggtgaaccgaatactgggacatgttaaaagagatgtctacctgacagactctttccccagacctccatctccctctaccactagcctacacgttcaaattaacctctcctgttcttttccttatgttatagggtgatcgcacaacctgcatctttagtgctttcttgtcagtggcgttgggagggggagaaaaggaaaagaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctccccgccctttcttagagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgccttttttttcttactgttttattacaaacttacaaaaatatgtataaccctgttttatacaaactagtttcgtaataaaactttttcctttttttaaaatgaaaaaaaaaagc

SEQ ID NO: 406823 - DNA, 2482 bp, Homo sapiens
tctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctccccgccctttcttagagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgccttttttttcttactgttttattacaaacttacaaaaatatgtataaccctgttttatacaaactagtttcgtaataaaactttttcctttttttaaaatgaaaaaaaaaagc

SEQ ID NO: 406824 - DNA, 2313 bp, Homo sapiens
tctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcacagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctccccgccctttcttagagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgccttttttttcttactgttttattacaaacttacaaaaatatgtataaccctgttttatacaaactagtttcgtaataaaactttttcctttttttaaaatgaaaaaaaaaagc

SEQ ID NO: 406825 - DNA, 2439 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttatgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctttttctctcgctctctttttttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacct

SEQ ID NO: 406826 - DNA, 1479 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgca

SEQ ID NO: 406827 - DNA, 1084 bp, Homo sapiens
agtgggaggagcttgcttctccattctggtgtgatccaggaacagctgtcttccagctctgaaagagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgca

SEQ ID NO: 406828 - DNA, 1096 bp, Homo sapiens
agggcgggggtggatgttggatggattagaaccatcacacttgggcccgctgtttgcctgaggttgaaccacaccccgatgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgca

SEQ ID NO: 406829 - DNA, 1303 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagggggtcaaaagtggtcagggattggcatcctttttttacgattgaaggcgtcttcaaggtactgcctagaatatgccgttgcgaacttgggcactttttaacttcaattgtgggctgagatttgcgcttaatagacaattaaaactgcccgttgcggggaaacccggggcgtaaaaagcgcagaaaagcgttcggagaattttttcccgctataaatactggtacaagaagagccaagattattcgagggaaaagaaagcctgacaacgtggggagtgaagca

SEQ ID NO: 406830 - DNA, 1008 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttatactcaggtgatacactaatgatcaatcgttttgtgtttctctgttttgtgtgtgtgtgtaa

SEQ ID NO: 406831 - DNA, 1437 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgca

SEQ ID NO: 406832 - DNA, 1799 bp, Homo sapiens
cgcggccgcgcgaccggctgcgagagacgacagaggggaactgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttatgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctttttctctcgctctctttttttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacct

SEQ ID NO: 406833 - DNA, 1268 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggtatggctgtgtacgttttgtgttacatttataagctggtgagattacggttcattttcatgtgaggcctggaggcaggagcaagatacttactgtggggaacggctacctgaccctccccttgtgaaaaagtgctacctttatattggtcttgcttgtttcaggcattaacccagataaatgccatgcaaattttataattattatgattgtttcaatttctggaagaaagttaatgaaacaaaaaatgtagtaaaatgccaaaggaacagtgacatttcagaaagaatgagggctttcatgttaattggtaagtcttggaatttctcttccttggagtaacaaatccctttgtgcctaatttcctaatttccaaaataaagttcttttacttataaaaacaccgaaccaaacaaaaccatatatggtttaacaaattacccatccccaaacacaaataggggaatattgcttg

SEQ ID NO: 406834 - DNA, 1260 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgca

SEQ ID NO: 406835 - DNA, 1077 bp, Homo sapiens
atctccctgtcactgatagaataatcagtgatcgctcacccccatacctttatcggggactgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgca

SEQ ID NO: 406836 - DNA, 1071 bp, Homo sapiens
  misc_feature (36)..(36): n is a, c, g, or t
  misc_feature (51)..(51): n is a, c, g, or t
gaaggcatgtaccaattttataacacagagagacanaccccctccatggtnaactgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgca

SEQ ID NO: 406837 - DNA, 2574 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttatgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctttttctctcgctctctttttttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacct

SEQ ID NO: 406838 - DNA, 1522 bp, Homo sapiens
agccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagggggtcaaaagtggtcagggattggcatcctttttttacgattgaaggcgtcttcaaggtactgcctagaatatgccgttgcgaacttgggcactttttaacttcaattgtgggctgagatttgcgcttaatagacaattaaaactgcccgttgcggggaaacccggggcgtaaaaagcgcagaaaagcgttcggagaattttttcccgctataaatactggtacaagaagagccaagattattcgagggaaaagaaagcctgacaacgtggggagtgaagca

SEQ ID NO: 406839 - DNA, 214 bp, Homo sapiens
cctaagcgctaaaggagctgtgctccagacctgttcctggaggaggccacaccggtctgtgtcctgggtctcagtgcagaccactcctagatgacctggaagttggatgttgattgtatctgacttaaggtggacccttcacttctctccctatttcagaagcacagggcaggcagttgcatgcatacatatccacggagcacctactgtgtat

SEQ ID NO: 406840 - DNA, 356 bp, Homo sapiens
tttgttgtgccatttaagggagggagtgatgacttgggatggaggggtggggggacccgggtcagacttgcagcttggctatgaggatggagatcagggagcccactgtgacaacaccttcaggactcaacgtgggcctgcaagccttgctgttttctcctcggccccttctccattcctatccacatccactacgctggcaaatccatcttttgagagggcaaatctgcttaaaaattgatgtaggaacagtttccaaaacttgtcattcagataccacctgcatgtggatttttttttttttagacaggatctcactcttgtcacccaggctggagtacagtggtacagtcatg

SEQ ID NO: 406841 - DNA, 1293 bp, Homo sapiens
gagatttaccggcggcatcttcttgggggtgctgggagccgggaagaccccctgaatcgttcccattgagctgcccttcgccttcgctttctttacttttgccttttcgacgtagccaacaagcacctggtcccgaggctgagagaaggctcgggtctaagcgcgtgtcgcgcttccggtctgggtagatttgctggggaagagggaagggggagggcccgggcaaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcgacctgggcgggcggaggagtgtgacgggccttagggccgctgtggatggtttctaaaatgatcattgaaaacttcgaggcactcaagtcctggctcagcaagactctcgagcccatgtgagtatccgggggatatctctttgcagggatggcagtgggagataggcggacccagagatctgtgcagtttccccaagtgcctgcggtggaggccgaagcggtgaacggaggtcccagggttctgtggcttctcctcctcgtccacctcgcttccagattcaggatacccccgagagcctgagtcgagctttattttattgctgagctgctctcgttttcccgttatatatagaccgtctccaacccccacccgcaatattttccgggggcctcaaaatcggtttattttagtgaaaccgactgtattttacttcctacagattattttaccttgtttttctaaatgaagtagacggcctttattggggattcgggcagttctagcttaaatcactcacgtttcacctaaatataattcctgaaagcaaggccacgtctcccatgtgctgtctggctcatctgcacctctcttcactgattgaagatgtaacaggtgctgaggtggccagtaaaattcccctttcccgcctacgcgttcgttagcttggagaggaggaagaaaattgaatcttcatccatatggaatatttagcagttttaagtgggatgctatagatagattttgtgttgggggctgcggttagagtgctgaaatagtcttagattggaaaatttaaggagtgttttgacgacttgttaatacaaaatatgacatggaccaaagtgctaatcagattggttgatttac

SEQ ID NO: 406842 - DNA, 783 bp, Homo sapiens
gagatttaccggcggcatcttcttgggggtgctgggagccgggaagaccccctgaatcgttcccattgagctgcccttcgccttcgctttctttacttttgccttttcgacgtagccaacaagcacctggtcccgaggctgagagaaggctcgggtctaagcgcgtgtcgcgcttccggtctgggtagatttgctggggaagagggaagggggagggcccgggcaaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcaatgcttttttttttttttttttctcttgaaatctattttatctgatagaaatatagcaactcctactcttttttggttttcatttgtgtggaatatctttttccatccctttattttaggcctatgtgtgtatttataggtgaagagtgtttcttgtaggcaacagattgttgggtcttgttttctttttttttttttttttttttaagttttttttctttatagagagagagtcttactgtgttgcccaggctggtctcaaattcctgggctcaagtgatcctccttgacaacccattatttaaaactgatggcaacttaacactaattgcaaaaaacaaaggagagaaaattaat

SEQ ID NO: 406843 - DNA, 1960 bp, Homo sapiens
gagatttaccggcggcatcttcttgggggtgctgggagccgggaagaccccctgaatcgttcccattgagctgcccttcgccttcgctttctttacttttgccttttcgacgtagccaacaagcacctggtcccgaggctgagagaaggctcgggtctaagcgcgtgtcgcgcttccggtctgggtagatttgctggggaagagggaagggggagggcccgggcaaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagaggtaacgatttgtgttaataccttacaggttatttaaacacataagaggaataaccaaactgagtttttatcttctatatctttgtgttggagtcctcaggaccactcccagtttaaatgatttttctaggaggactcataggactctgcatataattatgcttatggccctggcttatttcagcaaaaggatataaagcaaagtcagcaaatggaaaaggtgtatgaggccaagtccagtggaaaacaagcacaagcttacaaagtcctcagagttgcacaggatgtgcttaattcccctagcagtgaactgtaacaacacatgggaattaggcaagctccttagaaactctgccctgcgttcttatttggaactggtcacataggcaccgcctacctagtatgtaccaaaattccagactcctgggaggaaggcagatgttcagtgtagaccatattgtttcataactaattcaggcatagtgaaccattccttatcagggggtaatgggaaccctcgagaaatcaaagtgcccaggagccagccttacaagcatgctggctttctaaggttagtattgtcaggcctgcttttactctgcacaatatcttacagatatagagtcttaatatctgttctatgaaaataattaggttgacaattggtctgtttgcttttgtcatacatgtatttagtaggggactgtttttaaggtagtaaaacacaaggaccttcacaagacagtggatatgacttcatacttcaagaggtcccaaaatttttgtgtgtattttacaaccttctctcttcacccttagttactagtcatataataatttatatcttttcaatttgatgttaaaagattataatttggccagggtgagcgtggtggctcatgcctgtaatcccagcactctgggaggctgaggcaggaggctcacttgagcccaggagtttgagaccagtctgggttatatagtgagacctcatctcttatgaaaaaaattttaaaattagccaggtgtgatggggtggtgcatgcttgtagtcccaactacttgaggggctgaggtgggagaactgcttgagccccagagcctgagggtgcagatcaaagcattacactgcagcctaggcaactgagcaagaccctgtctgg

SEQ ID NO: 406844 - DNA, 1883 bp, Homo sapiens
tggtagagactgggtttcgccattttgcccagactggtcttgaactcctgggctcaagcgatctgcccgcctaggtctcccaaggtgctgtcattacaggactgattcactgtgcctggcctcaatactgtttattgcataatttatctcttcttagttggtttggatgccacttttataaaatctgaattcctagtacatttggatccatttctagactttctttttttgctgtttaaactaatatactgatgggtatgtttttaagaaataaaatggctacacatagcattaaggagtgttagtataaagagaacttaaatttcttcaaggtcctctgtgacccgggtgctttttacatgtattaactcacttaactattattctcactaattcagtttgtaactggaatttgtagaatgtgcagttggctaaattttcttcaacattggtttttttctttagctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagaggtaacgatttgtgttaataccttacaggttatttaaacacataagaggaataaccaaactgagtttttatcttctatatctttgtgttggagtcctcaggaccactcccagtttaaatgatttttctaggaggactcataggactctgcatataattatgcttatggccctggcttatttcagcaaaaggatataaagcaaagtcagcaaatggaaaaggtgtatgaggccaagtccagtggaaaacaagcacaagcttacaaagtcctcagagttgcacaggatgtgcttaattcccctagcagtgaactgtaacaacacatgggaattaggcaagctccttagaaactctgccctgcgttcttatttggaactggtcacataggcaccgcctacctagtatgtaccaaaattccagactcctgggaggaaggcagatgttcagtgtagaccatattgtttcataactaattcaggcatagtgaaccattccttatcagggggtaatgggaaccctcgagaaatcaaagtgcccaggagccagccttacaagcatgctggctttctaaggttagtattgtcaggcctgcttttactctgcacaatatcttacagatatagagtcttaatatctgttctatgaaaataattaggttgacaattggtctgtttgcttttgtcatacatgtatttagtaggggactgtttttaaggtagtaaaacacaaggaccttcacaagacagtggatatgacttcatacttcaagaggtcccaaaatttttgtgtgtattttacaaccttctctcttcacccttagttactagtcatataataatttatatcttttcaatttgatgttaaaagattataatttggccagggtgagcgtggtggctcatgcctgtaatcccagcactctgggaggctgaggcaggaggctcacttgagcccaggagtttgagaccagtctgggttatatagtgagacctcatctcttatgaaaaaaattttaaaattagccaggtgtgatggggtggtgcatgcttgtagtcccaactacttgaggggctgaggtgggagaactgcttgagccccagagcctgagggtgcagatcaaagcattacactgcagcctaggcaactgagcaagaccctgtctgg

SEQ ID NO: 406845 - DNA, 1110 bp, Homo sapiens
gagatttaccggcggcatcttcttgggggtgctgggagccgggaagaccccctgaatcgttcccattgagctgcccttcgccttcgctttctttacttttgccttttcgacgtagccaacaagcacctggtcccgaggctgagagaaggctcgggtctaagcgcgtgtcgcgcttccggtctgggtagatttgctggggaagagggaagggggagggcccgggcaaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcaggggtaaa

SEQ ID NO: 406846 - DNA, 1373 bp, Homo sapiens
gtggataggtcttggctcccagtttccttctgggcagacattgcccctctgccctgaggacctgcttgtttgggggaagaggcctttagaggcaccaggtcatgccaggtgttggacatggtgaactgggaagtgctcccatctggccacagcgcagaagtatcaccgtgctgggggatggggaacagggctgtgaatgggcctatttgcataagcagcatgtgtctggagagaaagacatcacagagcagaagagtgcgggtgcccaggagtgcacttgccacccctacttcatccctgaaagagtaaatggcctggaaggtgtctctgagaggtaatgccgcacaccaccctccctgggggcagggtcaggctacacctgccttaggtcgggggctgcagcagcctgagagctctcagtagggcctcagtagcctgggagggagcaggggcagggggcagggaaagaggcgtaatggggctgtccagaggggcctgggaaacctggtccctgaggcctgggcacagctacaatcacttcaaattggctgtggggccagtggactgggaaggaaaaaagcaataagagtgaccaagtgcagaaggctgtcaggtcccaggtcacatgccttagtgcagtgactcctcatcattttatggggtgtgggtgtcgttggtacacccattttacagatgaggacaccgaggcccagaaaagttaagttacatgtcctaagtcacacagcttgtaagtgccagaactgagatcaaaaccaagtctctttgactttaaagtctgtactctgaccccaaagagatcctgtttggccacttataggaggtccctaaagctgcagactccccttgccggcacccacatatagagacattaacccttcccctgcagggtcacctcaaatagtcttttagctgggcttctcctgcaattccacctaatgccatcccctgggttttgcccaaacctgaactgggcagtggggtgagaggaggggtttacagggttacagagcctcatacagataggagcccatggctgctggtcatctgcattcctgcaggattggctgttccttggggtccttggcaggaaaatgaggattgctccgaggcctgctccagtacttcccagaggctggcctggtgtggggctctgggaaggctgaggctggagaagcgtaagtaggagggcagagatggcactcaggtagcttgaatcaccaggacccttccaagccccacaggttctgagggagtactagggccagctctgggagaggtctcttcctatgctgtgaaccccctgcctttcttgcagcctacaacgaataaattttctttgcaaaggattccgt

SEQ ID NO: 406847 - DNA, 2057 bp, Homo sapiens
tgtagaaaacatattcattgaaaagtgagtgtccattgcacatgactgtgcatatcaacaacatataatctggccacacccacccctctttagccatgccaagggtgagctgcagagttacaacagctgttttggattcttgtaagtgttcatgtcatcatcagtacgaggtccacttctcttcacttctgcttcttcacagttaacaaaccagggaagtgtgccttgtctttctccagataggttaaaaaggccgcaggaattcagagagtaaccaacttgtcactaatacagcctttttgccaggccaccagagcatttgaaaagatagttactactgctaagagtcatatcattgagcagaaccttgtacagtgaaacatttttatgtgtgtctttgaattctttaagcaaaggcagagcagtttggtactggaaatcacaacaaagaaaagcacattgcacattccctaactgccattattaaaataattacttcatttattggagtgtttcacattgccgggcactatcatgggtgctttacactcattgtcttattcagtcctcacattgctcctacaaagactataattttattatttcccttttgcagaagaaaacaaaaacaaactaagagtcagattaagtaagcacatagcacacgacagcagaaggtgagcccaggtttgtttgaatgcctctaaagcccatgctttttcctttgtacctccccacatgctccatctactttggttaggtagctccagcctctgccctgtgccaaggggctgaaagtctctgaagacctgatgacccagcttccagtcagatccttaccctgtctacttccagtccccccatgtggctgtgctggaagctctcggatatgccttgtcccagcttctacaggctgaggaagctccagagaagatcattccccctgcttctgccagcagctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatatta

SEQ ID NO: 406848 - DNA, 1888 bp, Homo sapiens
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccccctgcttctgccagcagctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatatta

SEQ ID NO: 406849 - DNA, 688 bp, Homo sapiens
gagagggtatccaggcagaagaaatagcatgtgcaaaagctcggaaatgtaaaaaaaagaaaaagaaaaagctcatgttaggctggttgttgttagagtgtaggttgcatggggagaatggctagaggagtaggttttgccaggctgagaggtttaaatatccttgaaagaaccctgtatgaaggcaggatagatattgttattctcattttcaggtgaggaaacttaggttcaggtcccatatggagtaagtggcaggtatggtattagaactcagttctgattctctgtccactccactgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatatta

SEQ ID NO: 406850 - DNA, 427 bp, Homo sapiens
  misc_feature (1)..(1): n is a, c, g, or t
  misc_feature (20)..(20): n is a, c, g, or t
nttttttttttttctttttntattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgtagcgggcccagagcttgggctgcacatcggagcattcgcggattaggatgggtaggtcgggattcgccttcttcagctccacgtagcgtttctcaatgaagtccctgacgccctggctgccgggcgagcgctgacataagtggatgcgaatctcacgcaggcccagctttgccccgactcctcgacttgctgcggccgc

SEQ ID NO: 406851 - DNA, 2467 bp, Homo sapiens
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgtagcgggcccagagcttgggctgcacatcggagcattcgcggattaggatgggtaggtcgggattcgccttcttcagctccacgtagcgtttctcaatgaagtccctgcggggccggagagagcgccgcgcgtgctgtgggcgggggcttccctcaacttcagggaggtcgaggtcgtgaccctggcgtcccgaagcccgcccgcctcaccacgccgcgcctcacctgacgccctggctgccgggcgagcgctgacataagtggatgcgaatctcacgcaggcccagctttgccccgactcctcgacttgctgcggccgc

SEQ ID NO: 406852 - DNA, 2711 bp, Homo sapiens
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggtataggtttctggcccacatcctcagtcacccctgttctgaagccacacagtggctcccttcccatccagtcctaactatagttgtttctctgggcctggctaacctatataggttccatgtcagaaacttcatcctcttgttggggaatgcaccctctggagtaggctgacccatgaggctgtgggaattgagtcttaggacacagagaccaggtgtgttgaattttcttccctgcccctaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgtagcgggcccagagcttgggctgcacatcggagcattcgcggattaggatgggtaggtcgggattcgccttcttcagctccacgtagcgtttctcaatgaagtccctgcggggccggagagagcgccgcgcgtgctgtgggcgggggcttccctcaacttcagggaggtcgaggtcgtgaccctggcgtcccgaagcccgcccgcctcaccacgccgcgcctcacctgacgccctggctgccgggcgagcgctgacataagtggatgcgaatctcacgcaggcccagctttgccccgactcctcgacttgctgcggccgc

SEQ ID NO: 406853 - DNA, 2340 bp, Homo sapiens
  misc_feature (2218)..(2218): n is a, c, g, or t
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgttagcggggcccaagagctttggggcttgcaacatccgggaacaattccgccgggaatttagggattgggntaagggtccggggaatttccgccctttcctttccaggccttcccaacggttaggcggttttccttcaaatgtgaaagtccccttggacgccctgtggcttgccggggcggaggccgcttgaa

SEQ ID NO: 406854 - DNA, 2835 bp, Homo sapiens
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggtcagtgtggatggtgtggtggagggaggagttggggctctgagggatggaccacaagctaagcagggctctggtactcactcacataggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagtaagccctgtcccttcctatcttgttcttggtttagattttaaaattgtgcttttgggaccagtttgagctggcaggtaggaggaagaaaacatgtttgcccttatgcctacagccatggctacacccatcatctccccaccctcttgtgagccgcaaggatagctgctccagcgtccccatcacctcccctccccatctccccacacgcagcctggcatgaaacaggccaagcccagtgcttttgttgcctgttctcaggagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccccctgcttctgccagcagctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgtagcgggcccagagcttgggctgcacatcggagcattcgcggattaggatgggtaggtcgggattcgccttcttcagctccacgtagcgtttctcaatgaagtccctgcggggccggagagagcgccgcgcgtgctgtgggcgggggcttccctcaacttcagggaggtcgaggtcgtgaccctggcgtcccgaagcccgcccgcctcaccacgccgcgcctcacctgacgccctggctgccgggcgagcgctgacataagtggatgcgaatctcacgcaggcccagctttgccccgactcctcgacttgctgcggccgc

SEQ ID NO: 406855 - DNA, 2273 bp, Homo sapiens
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggtagctccagcctctgccctgtgccaaggggctgaaagtctctgaagacctgatgacccagcttccagtcagatccttaccctgtctacttccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgtagcgggcccagagcttgggctgcacatcggagcattcgcggattaggatgggtaggtcgggattcgccttcttcagctccacgtagcgtttctcaatgaagtccctgcggggccggagagagcgccgcgcgtgctgtgggcgggggcttccctcaacttcagggaggtcgaggtcgtgaccctggcgtcccgaagcccgcccgcctcaccacgccgcgcctcacctgacgccctggctgccgggcgagcgctgacataagtggatgcgaatctcacgcaggcccagctttgccccgactcctcgacttgctgcggccgc

SEQ ID NO: 406856 - DNA, 1285 bp, Homo sapiens
gagagggtatccaggcagaagaaatagcatgtgcaaaagctcggaaatgtaaaaaaaagaaaaagaaaaagctcatgttaggctggttgttgttagagtgtaggttgcatggggagaatggctagaggagtaggttttgccaggctgagaggtttaaatatccttgaaagaaccctgtatgaaggcaggatagatattgttattctcattttcaggtgaggaaacttaggttcaggtcccatatggagtaagtggcaggtatggtattagaactcagttctgattctctgtccactccactgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgtagcgggcccagagcttgggctgcacatcggagcattcgcggattaggatgggtaggtcgggattcgccttcttcagctccacgtagcgtttctcaatgaagtccctgcggggccggagagagcgccgcgcgtgctgtgggcgggggcttccctcaacttcagggaggtcgaggtcgtgaccctggcgtcccgaagcccgcccgcctcaccacgccgcgcctcacctgacgccctggctgccgggcgagcgctgacataagtggatgcgaatctcacgcaggcccagctttgccccgactcctcgacttgctgcggccgc

SEQ ID NO: 406857 - DNA, 207 bp, Homo sapiens
ttcaggtcccatatggagtaagtggcaggtatggtattagaactcagttctgattctctgtccactccactgcaaggtagatgcttattagttgcattagtgtgaatgacaagttctgaaggtgtgatattggaaggctcacaggtgaagtgggcagagagagacttaggacttgctttctgtgaaccgtgtgttctcctttccctg

SEQ ID NO: 406858 - DNA, 429 bp, Homo sapiens
tgggattacaggcataagccaccacgcctaggcaactgcttctcttcttaaaggtggaattgactatatacctagggactgcttgcttcctgttgcccagccaggtcagcaatcctctgctcattggccatggggctctgtctactctggggttgctgctgttggacttggctggggctgtccagaaaaccgaggatgcaggactggagctggtaggtgaagatgtcaggtgaaattctgggagatgtttcttgatactctggaatgcaggtaacctcttccttcttacacctgaccccccaatttgtctttgcagctggcatgccccgtgcttcgatgtctaagcaacctgctaactgaggcagcagtggagactgtgggagggcaaatgcagctcagagatgagcgtgttgtggcagccttatttat

SEQ ID NO: 406859 - DNA, 348 bp, Homo sapiens
cgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagct

SEQ ID NO: 406860 - DNA, 1022 bp, Homo sapiens
  misc_feature (779)..(779): n is a, c, g, or t
  misc_feature (799)..(800): n is a, c, g, or t
  misc_feature (807)..(807): n is a, c, g, or t
  misc_feature (816)..(816): n is a, c, g, or t
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatnttgggctccatctccctcannaatgtanaaatgttgnaagctgggcaaaggtctgcaagcaggtaagcaatctctgtcattgcatggggtctgtctactctggggtggtgtgtgaactggtgggtgtcagaaaacgagatgagactgagtgggatgccgtgttgatgttaagaactgtactgagagagtgaatggggggcagggtagataggtggagtatatcttggagttacagaagtgagg

SEQ ID NO: 406861 - DNA, 2347 bp, Homo sapiens
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgtagcgggcccagagcttgggctgcacatcggagcattcgcggattaggatgggtaggtcgggattcgccttcttcagctccacgtagcgtttctcaatgaagtccctgacgccctggctgccgggcgagcgctgacataagtggatgcgaatctcacgcaggcccagctttgccccgactcctcgacttgctgcggccgc

SEQ ID NO: 406862 - DNA, 2315 bp, Homo sapiens
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgctgaagagagagagggaggtgtctttaactattctgcaccctggaggctaccaaagtaaaataaaagatctttgtctttatcttagtcttgttaagacaggaagagtattaaagagatatgatcaaaatacatttggtatgcctagaattaatacaataggtctcaaaca

SEQ ID NO: 406863 - DNA, 2283 bp, Homo sapiens
ggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagctactttgcctcagtggttgcacagtaaggggtagagggtagatgaggacaagaacaccctgagaaagtattttacagcacaagctttatgaggaataggagaacacatttttttcacattatactaagtccagcagagcccaggctctggggctgttgctcttaatcctcagtggaggcttcaggctttaccacttagaacgttctccagggctctggttacctgatcagcactgaagttgttcaaagggacattcgtctcttggccaaatgcgtagcgggcccagagcttgggctgcacatcggagcattcgcggattaggatgggtaggtcgggattcgccttcttcagctccacgtagcgtttctcaatgaagtccctgcggggccggagagagcgccgcgcgtgctgtgggcgggggcttccctcaacttcagggaggtcgaggtcgtgaccctggcgtcccgaagcccgcccgcctcaccacgccgcgcctcacctgacgccctggctgccgggcgagcgctgacataagtggatgcgaatctcacgcaggcccagctttgccccgactcctcgacttgctgcggccgc

SEQ ID NO: 406864 - DNA, 1467 bp, Homo sapiens
gggctggtacggtcggacagtttgggatgaagtgtttgccacctaatttagacttacttaaatataatagaagttatactgtagaaaacgcttatgaatgcagtgaatgcgggaaagccttcaaaaagaagtttcatttcattagacatgaaaaaaatcatacaaggaaaaaaccttttgaatgcaatgactgtggaaaagcctatagcaggaaggcacaccttgcaactcatcagaaaattcataatggagagagaccctttgtgtgcaatgattgtgggaaggcgtttatgcataaagcccaactcgtggtccaccagagacttcacactggagagaagccttatgagtgcagtcaatgtgggaaaacattcacttggaactcctcatttaatcaacacgtgaaatctcatacacttgagaagtcatttgaatgtaaggaatgtgggaaaaccttcaggtatagttcatccctttataaacattccagatttcatacaggagagaaaccctaccagtgtatcatatgtggcaaagcttttggcaacacatccgtgcttgttacacaccaaagaattcatacaggagagaaaccttacagttgtattgaatgtggcaaagccttcatcaagaagtcccatctcctcagacatcagataactcatacaggagagaagccctatgaatgtaacagatgtgggaaagcattttcccagaagtcaaatcttattgtacatcagaaaattcatacataatattcactttatgaatatgagaaggccttattaaatatttgctaaatcttattaaatactaaagaattcatggtgagaagtctacaatttaaatgaatttggaagagtagattcccataaaaaacaaccaatgccaatcatgttctggaagtgataataaactttttacagaaaatatgacagaaaacaactataaataatagagcataaagcttggaaagtaagcataacttaaaaaatcaaagaaccagtgaaaactacatttgccattcctgacttttaatttttataataaaataattatgcaagtgtgagtttaaaatatatgcttatacattatattaaagtatgcctattaacagtttctgcagtaaataacattttttcttccagtctcaacatacataattaatcaagtgagaaaatgtgttttaatatgtcatatgaatttcagtgatattttcatccatttgctggcacttttaatgggcatgacagtgtttctgaatctgagtctcctttaattatacaagtgaagacttcttattaaaattaatataaagatattttcctatgtatgtaaataccagaacaaaaaacaagacactaattgaggagagaaaggcacttgtattctgtattacagtaagtattcagttgaggaaaagaattatttaaatatgtaaataaataatttgcacttcaaaaaatt

SEQ ID NO: 406865 - DNA, 385 bp, Homo sapiens
ttccgcacacgcgtagtaggacggtagccggtattcaatcttcaaatcagcgccgcgggaagtgcgggcgggtgttgctcccctgtctctggacgacgctgtgactgatcccaggcttggagccggagctgcgagcgaggcagtgaaagggtggcaggtatggctttgctggactcggaggacgtaagagaaaggcggggactggcttctaggtttaccctaccgaagataaaactttagtctccaagcgcagtgacttcaggtttggatatgtgggtcctgttcaactcgagtagctgagagaaagcaagagttgggctccgactggcactgggtagatgtccagggctctggtgggactgggagaggctcaatttgcattcct

SEQ ID NO: 406866 - DNA, 2030 bp, Homo sapiens
ttccgcacacgcgtagtaggacggtagccggtattcaatcttcaaatcagcgccgcgggaagtgcgggcgggtgttgctcccctgtctctggacgacgctgtgactgatcccaggcttggagccggagctgcgagcgaggcagtgaaagggtggcagatttctgtgtaagagctgcagaaaatgatcagcttccaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccagaatctgactacccacttgttgatgaaccagggaagcatcgggaaagcaaagacaattttttgaagtcagttttgctcacattcaataaaattctgactatggagagaatccaccattataatatgagcacaagtcttaatccaatgagaaaaaaatcatataaatcgtttgagaagtgtttgccacctaatttagacttacttaaatataatagaagttatactgtagaaaacgcttatgaatgcagtgaatgcgggaaagccttcaaaaagaagtttcatttcattagacatgaaaaaaatcatacaaggaaaaaaccttttgaatgcaatgactgtggaaaagcctatagcaggaaggcacaccttgcaactcatcagaaaattcataatggagagagaccctttgtgtgcaatgattgtgggaaggcgtttatgcataaagcccaactcgtggtccaccagagacttcacactggagagaagccttatgagtgcagtcaatgtgggaaaacattcacttggaactcctcatttaatcaacacgtgaaatctcatacacttgagaagtcatttgaatgtaaggaatgtgggaaaaccttcaggtatagttcatccctttataaacattccagatttcatacaggagagaaaccctaccagtgtatcatatgtggcaaagcttttggcaacacatccgtgcttgttacacaccaaagaattcatacaggagagaaaccttacagttgtattgaatgtggcaaagccttcatcaagaagtcccatctcctcagacatcagataactcatacaggagagaagccctatgaatgtaacagatgtgggaaagcattttcccagaagtcaaatcttattgtacatcagaaaattcatacataatattcactttatgaatatgagaaggccttattaaatatttgctaaatcttattaaatactaaagaattcatggtgagaagtctacaatttaaatgaatttggaagagtagattcccataaaaaacaaccaatgccaatcatgttctggaagtgataataaactttttacagaaaatatgacagaaaacaactataaataatagagcataaagcttggaaagtaagcataacttaaaaaatcaaagaaccagtgaaaactacatttgccattcctgacttttaatttttataataaaataattatgcaagtgtgagtttaaaatatatgcttatacattatattaaagtatgcctattaacagtttctgcagtaaataacattttttcttccagtctcaacatacataattaatcaagtgagaaaatgtgttttaatatgtcatatgaatttcagtgatattttcatccatttgctggcacttttaatgggcatgacagtgtttctgaatctgagtctcctttaattatacaagtgaagacttcttattaaaattaatataaagatattttcctatgtatgtaaataccagaacaaaaaacaagacactaattgaggagagaaaggcacttgtattctgtattacagtaagtattcagttgaggaaaagaattatttaaatatgtaaataaataatttgcacttcaaaaaatt

SEQ ID NO: 406867 - DNA, 513 bp, Homo sapiens
tgattctcttgcaagttcgctagtgatacacactttagtttgaagataaatgtgctgttacaggaatcagtgacattccaggatgtggctgtggatttcactgcagaggagtggcagctgcttgattgtgctgagagaaccctgtattgggatgtgatgttggagaactatagaaacctcatctcagtgggtaaggacaatgagtggtaacttttcagtgtaattcagtgtatactaatagtgctcattttttaagacttgggaacgtttgccaattgtggtcgctcatgcttataatcccagcactttgggaggcaggagaattgcttgagcccaggatttcaagaccagcctgagcaacgttgtgagactgtctcaacaaaatttagctaggtgtggtggtacatgcctgttgtcccagctacttgggaggctgaggtggaaggatcgcttgagcctaggtgtaccactgcattccagcctgggtgacagagtgagaccctatctcaaaaa

SEQ ID NO: 406868 - DNA, 1991 bp, Homo sapiens
ttccgcacacgcgtagtaggacggtagccggtattcaatcttcaaatcagcgccgcgggaagtgcgggcgggtgttgctcccctgtctctggacgacgctgtgactgatcccaggcttggagccggagctgcgagcgaggcagtgaaagggtggcaggaatcagtgacattccaggatgtggctgtggatttcactgcagaggagtggcagctgcttgattgtgctgagagaaccctgtattgggatgtgatgttggagaactatagaaacctcatctcagtgggatgtccaattaccaaaacaaaagtgatcctcaaggtagagcaaggacaagagccatggatggtggagggagcgaatccacacgagagctctccagaatctgactacccacttgttgatgaaccagggaagcatcgggaaagcaaagacaattttttgaagtcagttttgctcacattcaataaaattctgactatggagagaatccaccattataatatgagcacaagtcttaatccaatgagaaaaaaatcatataaatcgtttgagaagtgtttgccacctaatttagacttacttaaatataatagaagttatactgtagaaaacgcttatgaatgcagtgaatgcgggaaagccttcaaaaagaagtttcatttcattagacatgaaaaaaatcatacaaggaaaaaaccttttgaatgcaatgactgtggaaaagcctatagcaggaaggcacaccttgcaactcatcagaaaattcataatggagagagaccctttgtgtgcaatgattgtgggaaggcgtttatgcataaagcccaactcgtggtccaccagagacttcacactggagagaagccttatgagtgcagtcaatgtgggaaaacattcacttggaactcctcatttaatcaacacgtgaaatctcatacacttgagaagtcatttgaatgtaaggaatgtgggaaaaccttcaggtatagttcatccctttataaacattccagatttcatacaggagagaaaccctaccagtgtatcatatgtggcaaagcttttggcaacacatccgtgcttgttacacaccaaagaattcatacaggagagaaaccttacagttgtattgaatgtggcaaagccttcatcaagaagtcccatctcctcagacatcagataactcatacaggagagaagccctatgaatgtaacagatgtgggaaagcattttcccagaagtcaaatcttattgtacatcagaaaattcatacataatattcactttatgaatatgagaaggccttattaaatatttgctaaatcttattaaatactaaagaattcatggtgagaagtctacaatttaaatgaatttggaagagtagattcccataaaaaacaaccaatgccaatcatgttctggaagtgataataaactttttacagaaaatatgacagaaaacaactataaataatagagcataaagcttggaaagtaagcataacttaaaaaatcaaagaaccagtgaaaactacatttgccattcctgacttttaatttttataataaaataattatgcaagtgtgagtttaaaatatatgcttatacattatattaaagtatgcctattaacagtttctgcagtaaataacattttttcttccagtctcaacatacataattaatcaagtgagaaaatgtgttttaatatgtcatatgaatttcagtgatattttcatccatttgctggcacttttaatgggcatgacagtgtttctgaatctgagtctcctttaattatacaagtgaagacttcttattaaaattaatataaagatattttcctatgtatgtaaataccagaacaaaaaacaagacactaattgaggagagaaaggcacttgtattctgtattacagtaagtattcagttgaggaaaagaattatttaaatatgtaaataaataatttgcacttcaaaaaatt

SEQ ID NO: 406869 - DNA, 2087 bp, Homo sapiens
tgtcggagttctgtctgggcctattcgggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggtcactgcgtgttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaa

SEQ ID NO: 406870 - DNA, 3261 bp, Homo sapiens
gggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaacccgggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggtcactgcgtgttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaaaaaaaaaaaaaaaaaaaaaaaaaaaaaaattttggggccggcttgggcccttgaaaagagttttttataaaccaattctcgggttgggcggcgggggacccatatatggtgttatgtgaactgtggcaataacggggttccctaaggagaaaccgtgcgccatggactaggggcgtggcttctctccacaaataaaaaaaacggccggggggaaaaccgggggtctggaacaacttccagaggggggctccggagggcacaatacagggctcttcacagggggggtcaagcgagccgagtattaaaataagccggag

SEQ ID NO: 406871 - DNA, 1080 bp, Homo sapiens
ccttgattctgcaatagtcgactctatgaggatacccttactgtttcactcttaaggagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaa

SEQ ID NO: 406872 - DNA, 283 bp, Homo sapiens
cctaacgagcccttccgtaacagccttccgtaacagcgcctcctaacccctccgtaacagcgcccagtggtggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaa

SEQ ID NO: 406873 - DNA, 1560 bp, Homo sapiens
gggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaacccgggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggggaacatccttgccagggagtttctgagggtctgctttgtttacctttcgtgcggtggattctttttaactccgtctacctggcgttttgttagaaatgtcagataggaaaataaaaaccatttgagtaaaaaaaaaaaaaaaaaaaaaaaaaaaaaaaaaaattttggggccggcttgggcccttgaaaagagttttttataaaccaattctcgggttgggcggcgggggacccatatatggtgttatgtgaactgtggcaataacggggttccctaaggagaaaccgtgcgccatggactaggggcgtggcttctctccacaaataaaaaaaacggccggggggaaaaccgggggtctggaacaacttccagaggggggctccggagggcacaatacagggctcttcacagggggggtcaagcgagccgagtattaaaataagccggag

SEQ ID NO: 406874 - DNA, 2944 bp, Homo sapiens
gggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaacccgggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggtcactgcgtgttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaa

SEQ ID NO: 406875 - DNA, 1912 bp, Homo sapiens
gaacataattccggcctaaagggtttagagagcccccctggggatttaagaaagtaccaggtgcacgatggttgccgtcactgcgtgttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaa

SEQ ID NO: 406876 - DNA, 2547 bp, Homo sapiens
gggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaacccgggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggtcactgcgtgttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaa

SEQ ID NO: 406877 - DNA, 1048 bp, Homo sapiens
gagagcttagagtgtatttttattcttttttttccatttccttttctcttttcatcttttttctttctttctttctttcctttttttcctttgtatttttatcttaacatgcctagacagagaagaacactggattgtacataatgggctttctttgactctcttttccagagtggaaataggattctgtgctccatcattctgagccatcaccaggggccgtccataatcaactatgatgatgagagtgggaagacatgtgtacatatcgcagcggcagcgggcttcagcgatattattcatgagctggcaagagtccctgagtgtaacctgcaggctctggatgtggatgacaggtatccatggtaaccagaaagtgctgggaaactagtcatttccccctaactgaatcttaaaataaaggagatgtttaaggaggtgtcctatacagctatatccctattgccagtaatacacatgggcttgtgacaataaaaattgctctattttagtgagaggagaaaaaattattgttatggagaggaagactgcgactgtacagtgttgtcagattttccactttttgctaaatgttctctgtgttctcagaagacgttctgtatttcagcttcctgctatgtgccctctttgttcctaaaggtaggttttggttgttttttttttcttcattcttggattatgttataaagtccacaagttcttttatccagagaagaacataatagagactttgtattctggactattgggcttttagaactgcaaggaactgtatcaggttgttgttgttttcgatcatcaaagatgtattgtctgaaaaaggaagctaggtccaaaaaggtaaaaagacttctgtcagagctagttagatactaaatgaagatttgtacacctgtctttcaaacttgtagcttttcatctataatgccctgcttatctaaactgttttggttaggcactgagtcaatggaaatgtaagaaaaatataacaacaaacaagactatcgaaaataagtatagacttgag

SEQ ID NO: 406878 - DNA, 772 bp, Homo sapiens
  misc_feature (52)..(52): n is a, c, g, or t
ttatggatacgtaagttaacttaaaatgagtgagaagaaaaggagaccgtgnggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtaggaaaactgagctatgtttggtttgctttgtggcatgtgcactgtttttttgttattgttctttggttgtttttttgctgaatgattttatgttttgggaaaaaaagtacgctttgctgaataaaaggcaaaaaacaaaacaaaaaaaaaaccacatcccagacaaacatgtcttcacatttattgtcattctaacttgaactaatgaaacctatttaaaaataaattcctatgatcagtcaca

SEQ ID NO: 406879 - DNA, 1908 bp, Homo sapiens
gagagcttagagtgtatttttattcttttttttccatttccttttctcttttcatcttttttctttctttctttctttcctttttttcctttgtatttttatcttaacatgcctagacagagaagaacactggattgtacataatgggctttctttgactctcttttccagagtggaaataggattctgtgctccatcattctgagccatcaccaggggccgtccataatcaactatgatgatgagagtgggaagacatgtgtacatatcgcagcggcagcgggcttcagcgatattattcatgagctggcaagagtccctgagtgtaacctgcaggctctggatgtggatgacaggacacctctgcactgggctgcagctgcagggaaggccgaatgtgtccagtcactgctggagttgggaatggacagcaacctgcgggacatcaatgagagcacgcccttggcctatgccctgtactgcggtcacacggcgtgtgtcaaactcctctcccaagagagcagaacagagcctactcgaccccctccctcccagagcagtcggccccagaagaaggagagacggttcaacgtgctcaaccaaatattctgcaaaaacaagaaagaagagcagagagcccatcagaaggatcccagcagggaccgatacagagaggaggacacctcagaagtcaatgacatcatcaccacctttgatagcatcgtgggtaccaactgccaagaacagcctggtgatcaggtggctatggttgaatttaagaagaaaacctcagacaattcaaaatatctcttaccagaaaagaaaccgctggcccgtaaggggcttccaccaatcagaacgcagagtctcccacccatcaccctgggcaataacttcctaacagcctcccatagggccacttcccatgcaggcctgagctctgctcctcatcatatggcccagcgatctcagaaaagtcgaagtgagcaggatttattaaataacagaactggctgccagatgttactagataacccctggaagagtgattctaatcaggtattttcctacaaagtttggactgtgtcttcttctgataagctgctggacagattgctcagtgtccggcctggtcaccaagaggtctccgtgccaccacaccttcgccatctacataatccatcatcaggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtaggaaaactgagctatgtttggtttgctttgtggcatgtgcactgtttttttgttattgttctttggttgtttttttgctgaatgattttatgttttgggaaaaaaagtacgctttgctgaataaaaggcaaaaaacaaaacaaaaaaaaaaccacatcccagacaaacatgtcttcacatttattgtcattctaacttgaactaatgaaacctatttaaaaataaattcctatgatcagtcaca

SEQ ID NO: 406880 - DNA, 783 bp, Homo sapiens
  misc_feature (7)..(7): n is a, c, g, or t
  misc_feature (14)..(15): n is a, c, g, or t
  misc_feature (21)..(21): n is a, c, g, or t
  misc_feature (24)..(24): n is a, c, g, or t
  misc_feature (58)..(59): n is a, c, g, or t
aagaaanaaaattnntagaanaantaaggtaatgaaggaatattataaatagaaaaannacttggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtaggaaaactgagctatgtttggtttgctttgtggcatgtgcactgtttttttgttattgttctttggttgtttttttgctgaatgattttatgttttgggaaaaaaagtacgctttgctgaataaaaggcaaaaaacaaaacaaaaaaaaaaccacatcccagacaaacatgtcttcacatttattgtcattctaacttgaactaatgaaacctatttaaaaataaattcctatgatcagtcaca

SEQ ID NO: 406881 - DNA, 1222 bp, Homo sapiens
atacttagagctagaggagaggcccctacacatgtccaccatcatccttcgggctcatttaacacttactatttctatactgtaaatggcaacaagattttccctacctcaacctgactttgagcaggagctgttgctggctaagcagcctgaacaattcacatgctcagaacagagcctactcgaccccctccctcccagagcagtcggccccagaagaaggagagacggttcaacgtgctcaaccaaatattctgcaaaaacaagaaagaagagcagagagcccatcagaaggatcccagcagggaccgatacagagaggaggacacctcagaagtcaatgacatcatcaccacctttgatagcatcgtgggtaccaactgccaagaacagcctggtgatcaggtggctatggttgaatttaagaagaaaacctcagacaattcaaaatatctcttaccagaaaagaaaccgctggcccgtaaggggcttccaccaatcagaacgcagagtctcccacccatcaccctgggcaataacttcctaacagcctcccatagggccacttcccatgcaggcctgagctctgctcctcatcatatggcccagcgatctcagaaaagtcgaagtgagcaggatttattaaataacagaactggctgccagatgttactagataacccctggaagagtgattctaatcaggtattttcctacaaagtttggactgtgtcttcttctgataagctgctggacagattgctcagtgtccggcctggtcaccaagaggtctccgtgccaccacaccttcgccatctacataatccatcatcaggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagc

SEQ ID NO: 406882 - DNA, 1554 bp, Homo sapiens
atacttagagctagaggagaggcccctacacatgtccaccatcatccttcgggctcatttaacacttactatttctatactgtaaatggcaacaagattttccctacctcaacctgactttgagcaggagctgttgctggctaagcagcctgaacaattcacatgctcagaacagagcctactcgaccccctccctcccagagcagtcggccccagaagaaggagagacggttcaacgtgctcaaccaaatattctgcaaaaacaagaaagaagagcagagagcccatcagaaggatcccagcagggaccgatacagagaggaggacacctcagaagtcaatgacatcatcaccacctttgatagcatcgtgggtaccaactgccaagaacagcctggtgatcaggtggctatggttgaatttaagaagaaaacctcagacaattcaaaatatctcttaccagaaaagaaaccgctggcccgtaaggggcttccaccaatcagaacgcagagtctcccacccatcaccctgggcaataacttcctaacagcctcccatagggccacttcccatgcaggcctgagctctgctcctcatcatatggcccagcgatctcagaaaagtcgaagtgagcaggatttattaaataacagaactggctgccagatgttactagataacccctggaagagtgattctaatcaggtattttcctacaaagtttggactgtgtcttcttctgataagctgctggacagattgctcagtgtccggcctggtcaccaagaggtctccgtgccaccacaccttcgccatctacataatccatcatcaggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtaggaaaactgagctatgtttggtttgctttgtggcatgtgcactgtttttttgttattgttctttggttgtttttttgctgaatgattttatgttttgggaaaaaaagtacgctttgctgaataaaaggcaaaaaacaaaacaaaaaaaaaaccacatcccagacaaacatgtcttcacatttattgtcattctaacttgaactaatgaaacctatttaaaaataaattcctatgatcagtcaca

SEQ ID NO: 406883 - DNA, 1312 bp, Homo sapiens
atacttagagctagaggagaggcccctacacatgtccaccatcatccttcgggctcatttaacacttactatttctatactgtaaatggcaacaagattttccctacctcaacctgactttgagcaggagctgttgctggctaagcagcctgaacaattcacatgctcagaacagagcctactcgaccccctccctcccagagcagtcggccccagaagaaggagagacggttcaacgtgctcaaccaaatattctgcaaaaacaagaaagaagagcagagagcccatcagaaggatcccagcagggaccgatacagagaggaggacacctcagaagtcaatgacatcatcaccacctttgatagcatcgtgggtaccaactgccaagaacagcctggtgatcaggtggctatggttgaatttaagaagaaaacctcagacaattcaaaatatctcttaccagaaaagaaaccgctggcccgtaaggggcttccaccaatcagaacgcagagtctcccacccatcaccctgggcaataacttcctaacagcctcccatagggccacttcccatgcaggcctgagctctgctcctcatcatatggcccagcgatctcagaaaagtcgaagtgagcaggatttattaaataacagaactggctgccagatgttactagataacccctggaagagtgattctaatcaggtattttcctacaaagtttggactgtgtcttcttctgataagctgctggacagattgctcagtgtccggcctggtcaccaagaggtctccgtgccaccacaccttcgccatctacataatccatcatcaggacaaaattttcagcatctttccccaaacagacacaaaatcagggatcttcctttcactcggaacaacctagctcccctaccagatcaaaaatttctatctggagaacctctgcggacaaaccgagtgcttcctgcaattccaagtcaacgaagacacagcacagcagcagaagagagtgaacattctgccaaccccaccagtgatgaaaattaactgtgggccactcgctgcagaaatgtagatgaatatgtattttcaactctcaaaggacaagattactccagtttgtaagaacgaagaccaatttagtaagctgcattctataagccatcagttttataactcgaaattctttattccaaataaagatactccctaaataagcacttagaatatttgggtgtgcatattaagtctgtgaatttctgtgacttccacatgccaaaattaaaagacaaaatatgttatcagtagg

SEQ ID NO: 406884 - DNA, 3649 bp, Homo sapiens
  misc_feature (1113)..(1113): n is a, c, g, or t
gcccaggtaaagccatgttttcctacacttaaaaatgtaaataaatatcccttagataatctggacagcagtttcttatatagcatgtctgagcactatattttgctgggctataaaaggtttaattgttgtttattggtacaataagggattctagttactaatatctacctgtagtcaataaagcaaacattgattggttgatcgaatcattgattcattcaataggtattgattcagcaccagctatgagctaggcagagttctaggccctacagagaaaactgatatcaaactaagaaagtctttttccaagtgctacagtaggggtgggggaggagagagataacaaactggtgagcaaatgttaaacaaaatgattctagagagtgctaaatactgtgaggaagataaaatgataaaataataaagacttctgaagattggttagggtaacctcttgtagaagtatcattggagaccgaaggatgacacaccagccatctgaccatgagagaacatcattcaaggcaaaggaaacagaccaccaccaacaaaaaaagatgcactggggaatttccagtaacacttttgttagctctcttaatatctgattttttgagcactagaacactgcctctcacagaatcctagcttaaaacagcaatgaacagactagaattctaggctaaaaccaacaagatgaaatgtgactgatatgaatataaatggtgcacataagttcacaaacccaattacacagcacaaaatgatatccacgtggcttgacagctgttcatattagaaaaatctagggattctaatggactacatattggagattgctctttgctgttcctgactggaaaaaaaaatatgtagatattacccttgggcagatttcagcccaacttaaagtatcattagagctgtccaaaatggaacagcctgctttgcacatagagaactcacattgctcaactcaaaaaagagcagaaggaaggaagaaggaaggacacgtaacagggatttttacaaaaacagaattcggtatttcttggagactactttaagacagtttttggtttctgtaagtctgtgacttattacttnttcctttaattccaataaaattttcttcatttttgttatttttaaaacattaagaagaaaaaaatgatattgatataaggtagatggtgaagtttagcaaaagtttagtttataatgatatctctcaaaatagcaaactgaagtttaaaattcttaagctataattttaaaggaatttagattaaacttttaatatgttgttggctaagtataatacaaaataaaaactaaataaatcttggttttgccacatattagctgtgtaatatagacaatttacttctctgttattgtttcctcagaatgagggcagtaacttgtagccgtctgaaaagattgttataagcatggagttagttgctgtatataaagcagttagaccagtacctgacaatattacatgctaagtaagtgcttgctattactgttgctgttattattaattataattgtgtgctctattctgccttcaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataactttgcttaaaatttttctgtattttaacttgtctagggttttctacttcttctatttttataatattttctcattttttagattactaaacattctacttatccacatgtgccaagatgtgccatttaggtctctgcagaaattagctgtttggtatcatcacctgccatacatgttgtgtgcagcagtgagaagtatattctctaccactgctctttctcatgattattttctctattcctattaaaatgaataattgatatgttaattaagtaaagcaaatcaataaggaatgaaatgcatggcccaaaacatagaaaatgaaaatcgtttgaccatttatccaattattgaacccaattaagatgatccattttaaatttaatatatgctcgcttttggaatgtgttatgcattgatgttaagtgaatggatctaagtaaatctattgatatctcta

SEQ ID NO: 406885 - DNA, 2686 bp, Homo sapiens
agcggagcctcggggagcagcccgggctgtttgttccgtcaccggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctggaggatcttaatgatttaagaatggagggagtaacaaccctggtaccttctgggagcaaatttaaccaaggccgtcctacttaccctgctgagcctcaggccaaggtcacactgaacatctgttcaaggtgtaggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataactttgcttaaaatttttctgtattttaacttgtctagggttttctacttcttctatttttataatattttctcattttttagattactaaacattctacttatccacatgtgccaagatgtgccatttaggtctctgcagaaattagctgtttggtatcatcacctgccatacatgttgtgtgcagcagtgagaagtatattctctaccactgctctttctcatgattattttctctattcctattaaaatgaataattgatatgttaattaagtaaagcaaatcaataaggaatgaaatgcatggcccaaaacatagaaaatgaaaatcgtttgaccatttatccaattattgaacccaattaagatgatccattttaaatttaatatatgctcgcttttggaatgtgttatgcattgatgttaagtgaatggatctaagtaaatctattgatatctcta

SEQ ID NO: 406886 - DNA, 613 bp, Homo sapiens
  misc_feature (492)..(492): n is a, c, g, or t
aaatgcaggaattcggtatcgagcacattatcagcaacataagaaactcctggccgcaatgctctctcaagattcttttgagtccatccacagccctaccccatctgtaacagaagaagatattgataatgaagatgatgcaatggaattgctgggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctgatgaatccttaaagcaattgcaggtagttcatcaaccatggatcttgccaagtgacacagaaagtgaaggagtggaagcagaacaagagaaacgtgagtagacactattgtttattgacaaatttcttttaccagaaggaaatccacaataaagctatttcactttcataaanaccccaaatcccccctttaggggggcgttttaaattcaccggccgggttttaaacaggcgggattggaaaaacccggggttccccaactataaccctgtggtccctttttcccacggtggt

SEQ ID NO: 406887 - DNA, 2553 bp, Homo sapiens
agcggagcctcggggagcagcccgggctgtttgttccgtcaccggggaaaggaggtacacacagtcgcgcgcgcacggacacacacacacacgcacgcacgcacacacaccggtggcgagttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggaattaatgaccaagttaataactgagacacctgaccagccaatcccatttctcattgaccatcttcagtctaaacaagggaaccgtggacaacttcaaagaactttgtctggatctgcagctctatgggcagaaagtgaaaaatcagaatccaaaggaacaagaagggatttcagaagctatgataaaccttggcaattaaatgcaaagaagcctaaaaaatcaaaaagtgaccttgctgtgtctaatatttctccaccatcaccggactccaaatcattgccaaggtcagtagagcatccaaagtggaactggaggactaaaccacaaagccgtgattttgatgaattgaatcacatccttcaggagagcaagaagctggggaaagcccttgagaatctctctcgaagtattgcaatttcagatgaactcgataaggaaacagtgacatttaattcttctcttctgaggccccgtgtgattggagaatggattggtagagaagaaaatgatgctgatcccctagctgctgaaatgctacagcctccaattccaagaagcaaaaatgaccaatgggaaagtgaagatagtggctctagtcctgcaggaagcttaaagatggagcctaagaacaaaggattaaaacagcagcaacagcaacataagaaactcctggccgcaatgctctctcaagattcttttgagtccatccacagccctaccccatctgtaacagaagaagatattgataatgaagatgatgcaatggaattgctgggcttcaaggagacaacctggaagaaaggacagaagagtcactaccaatactccattctccagatgaaaaaatcccagattcattcgattccttgcctgggactgaagaagcactaatggaggagggtgacgaatttgagaaagcatctaaactaacaggacctggagaagcctccagtggagtaggacactcactgaaaaactacatggaagaagatgaatccttaaagcaattgcaggtagttcatcaaccatggatcttgccaagtgacacagaaagtgaaggagtggaagcagaacaagagaaacgttccgctgatcttcttctttgcgttccatgctcttcttgtcctacgctggtctactctggtttgtgaaacagagagaagaagttgcaagtggtccttaaagaaatgcagttattcaaatccttatgtatagttctaattttatttactatgtgtaatcatttagagaatggttatttttataatctcaataataaacaagtactatcgtagccagggggtgcccaagtatgtaatcagagaacactaatcctggcaaaggattgtggggtggtcaggaggccggctgccttttgacatggttagagtcctgggtttagattactttataaatagttattaagattaatatttgatatattaaatattgcctgattcaaataactttgcttaaaatttttctgtattttaacttgtctagggttttctacttcttctatttttataatattttctcattttttagattactaaacattctacttatccacatgtgccaagatgtgccatttaggtctctgcagaaattagctgtttggtatcatcacctgccatacatgttgtgtgcagcagtgagaagtatattctctaccactgctctttctcatgattattttctctattcctattaaaatgaataattgatatgttaattaagtaaagcaaatcaataaggaatgaaatgcatggcccaaaacatagaaaatgaaaatcgtttgaccatttatccaattattgaacccaattaagatgatccattttaaatttaatatatgctcgcttttggaatgtgttatgcattgatgttaagtgaatggatctaagtaaatctattgatatctcta

SEQ ID NO: 406888 - DNA, 130 bp, Homo sapiens
caagacagaatgaatgcacagacaaaagaaaagggaaacttgaaattgtgagggccaaagtgagggacagtagaaagaacaaggaagggacaaaataatgtgggtttctatttctaacctcaattttagg

SEQ ID NO: 406889 - DNA, 177 bp, Homo sapiens
tcatgtctttcaatctgaaaaaaaaaaaaacccaaaaaaacaaaaaacaaaaaaaagcctcttggatgcaccactagagagtaataatccaaaaatcaggcagtccttggtctagttcatatgtcaccaccaccagctgtatgtctcccttaacctctgagtgtagattctttccta

SEQ ID NO: 406890 - DNA, 548 bp, Homo sapiens
actgctgtattcttgctgcaagaatacagcagtgaaaatatttgttgagtgaacaaattaattctgtttccacctagaaagcacttagcatagtgccttatacttgagaaagtgatcaataaatggtgtaaacaatggtcctcaccctggctgttatgctggggccccaccccagataactaaattagaattgcgggaggtgggaccttggcattgttatttttgtaaagcttctcaaaggattctaatgtaccgcttgggttgagaagcccttgtttgatacagcaaggaggttaatgatacctgactttttattaagtgcttattgttatggaggtattgaggtaagctacacagtgttatctcatgaaatcctcatcactggccagtggaagtagttactgctatccccattatttggtaaagaaactgaggctcataaagctaagggatagcaggtggtggagctgtcatttgagctcatgcaatttgtgtcaagagccccatctttttttttttttttttttttgagacagggtcttgccctg

SEQ ID NO: 406891 - DNA, 618 bp, Homo sapiens
aatcgtatgagaaacttcatccgattattaagctatcctcaaaaaactatgaaagcaaatgaaacataataaacccccaaaactgaagacagtcaaagcatttcaaacccctcagtatgcataatcctcaagattacaactaggacaatgttacttcgaatctaatactttgtaggctaatgatattattaacctctaattaatagcatcacctctaataacaacaactacatagagaacagctcctagaggtgctggatctcagtatcatttcctctggctctgaacagtacatcgtacattgtcagtcacattcccagcacaagttagaccatgtccctctcaggtttcctagcccaggtcatacatatattctgctgctttgtgacatccctgaaatgtctttaaagaatgaacggctgtcaattttaaggaatgacgaaagttatccccaaggaatgtcaggagtgttgagcatcagagaatccaatgttcccattaacagaataaagaagagaagctatatgttcattagattttttaaaaattgctgattcaacattaattcattataaaaactcaattaatgtcaaaatgtattcagtttgggcgggcaca

SEQ ID NO: 406892 - DNA, 509 bp, Homo sapiens
gagggatggtgtgctctgagcactctgcttcctcgatctgtcagcctggctggtctcccagggagggaacctgcgaagagcccccgaccctgcactgggaaagccccaaatacacagcttctcattttatgcttacggagatcctatatcactaccctcaggtcacagagaggtgcactgagttcatatgagtggaaattacccgccagtcaccagagcgtgagcaaaccggccagagcgaggggccctccccggccctcccaccacggagccggctccccttgccctttaggactcagccagacaccgccttccccgagcagtgctgttctcagcgtggaagtgcccgacatcgggagcttctccctccatcccagccagcactgctgtgggaagcacagccccttcgcttgcacttctccggatcaatgtttattttaggacctttaagtattgttttcttcagcgcagaaaatagtgcttaataaaatggaattcacctaatgcca

SEQ ID NO: 406893 - DNA, 773 bp, Homo sapiens
tgagggacccggttaccaacctgcatgacgctcagtttgcccatctgtcccagtggtaacacacagttctcgggagacgttccccattcccagaggagtagtgtgaaacgcgtgcgcctctagtcttaaacttggcgtttgtattagttgggtttcctggtgtctctttagcaagtgaagtttctggttccctccttcactgtgtgacctgcctagtcctcctgggtcgcatttacagaagtttatacgagacctagtttccagggaagaactcactgattccgcgagggagatggcttaatggatgatggtcgtcagccttaaggatacttcagtcttaactgtgtgttacaaagtttgaaagggagggttccctatgaataagaagcacacttgaaagaacagccatctggtctaacctctcactggtgcttcagaggaggaaaaaaggtcacagctatgtttccagtgtcctctgggtgtttccaagagcaacaagaaacgaataaatctctggctgcataaggggagtgaacacaaagtacatttgaccacaaaatgactctttaaaagtcagaactacggtagcatgaagccaaacgaggtccacgtaaaggctctgacactttctcggggacacactgctaagggttccacagaagtctccaatcttcaaatcttcagtgtataaaagcacagattcctgaaaggaatgggctcaaatgaaccaggaagtaggagctctctatatccctggtctgaaaaaaaagcta

SEQ ID NO: 406894 - DNA, 465 bp, Homo sapiens
aaaagcagaaattaaaagcagctgaacaaagaagagaataagaaaataatcatctggtaaccatcatagtaataattgttcaaacacaagtcatccatgaaatgctaaatctagtgggttctgaggagtaaccagatatttacagagcctcaaagtatctccatacaaaatacggttgaactacaaaaagaaaattgtaacattagcatggacaaacctgatgtggcttacccgtggattctagagaagaaagtagatgggagcaagtgtccaatacagcaacagctggaaagaaaaataaagaattttgttctttacctaaaacacttcagttaactaagtgtgagtttaaaaactaaagattgagaactttatcagagttaataagaatgagaaatatgtatgtacatttacaatacaaaattactatttaataatttacacatggcattaattctaattgtg

SEQ ID NO: 406895 - DNA, 409 bp, Homo sapiens
ttcagaacctcgtaacattgtgctggaaacctatgtgagggacaggcatttagaccctcgcagcagtgttctggaatcccatgtgagggtcaaacattcagatcctcgcagcagtgttctggaattctatgtgagtgacaaacattcagactccagcagcagtgatgtggcttacccgtggattctagagaagaaagtagatgggagcaagtgtccaatacagcaacagctggaaagaaaaataaagaattttgttctttacctaaaacacttcagttaactaagtgtgagtttaaaaactaaagattgagaactttatcagagttaataagaatgagaaatatgtatgtacatttacaatacaaaattactatttaataatttacacatggcattaattctaattgtg

SEQ ID NO: 406896 - DNA, 1530 bp, Homo sapiens
ccactccgccattttcctccggaagtgcggcacccagaggcggtcctgtagccgggccggcttggggcttggttctatgtccctgcggggaagaactcactgattccgcgagggagatggcttaatggatgatggtcgtcagccttaaggatacttcagtcttaactgtgtgttacaaagtttgaaagggagggttccctatgaataagaagcacacttgaaagaacagccatctggtctaacctctcactggtgcttcagaggaggaaaaaaggtcacagctatgtttccagtgtcctctgggtgtttccaagagcaacaagaaacgaataaatctctgttgaagagataccatttgacattttagagatggctgcatgcaaactcttgaaacatttgacgaccctccagggtgccccgactcactttccctgcagatggaggcaaggaggctccacagacaacccccctgcctgaggtcagatagtggccagcaggccagagctggcgcagagaaaatacaagctgagcttagaacatcttctgccagaaagtaaaaaagtgccgacagagtaatggagacaaatcaaagagacataaagtcagcttggaatgtctactactggcctaatcttggggaattggagcatcagaatcatgagctttctttctcccttatttattggttttatttctccatgtagaacaaagaagagaataagaaaataatcatctggtaaccatcatagtaataattgttcaaacacaagtcatccatgaaatgctaaatctagtgggttctgaggagtaaccagatatttacagagcctcaaagtatctccatacaaaatacggttgaactacaaaaagaaaattgtaacattagcatggacaaacctggcaggtactccttaactctcctaagtaataaaaactgtaaaatgcaaataagccttcgatgacctttactaacctttactaaagtatcagtgatgacttggttgtttaaacagctgacatttgggcaatttgagtatgtcaaactcaataatactggttttcatttgcaagatccacttaaaacttaaggaggccaaaaaacatcatttaaaataccctataaattataatcatacatatgatacgaaaaatatcctacttcagtaaatattggaatgttatatattttatgagaaacaattaaaatgtgtaaatagcccagtaataaagttttataatcttttaaatcatcatagaatttttccttaagactttatggttaaatattctcttcattagatgtggcttacccgtggattctagagaagaaagtagatgggagcaagtgtccaatacagcaacagctcagtcaagtagttctggcagttatttgaagtctgaggtttgaagtaggaattcttacgggcatttggggaatatattttctgttgagtcctatactagtaagattttcaacacaaggtgactctcgacctcaccttgtaggaagagtgctgagaaaatatttca

SEQ ID NO: 406897 - DNA, 969 bp, Homo sapiens
gggagaaaagtgaaacaacaataaagccccaagcataaacaaacaaaaagagttaagcaaaacaacaaatgcacaattcatatgattactgagtgttctaatggtgaacacttttatccaacttttctcaagtcagagtacagaacaaagaagagaataagaaaataatcatctggtaaccatcatagtaataattgttcaaacacaagtcatccatgaaatgctaaatctagtgggttctgaggagtaaccagatatttacagagcctcaaagtatctccatacaaaatacggttgaactacaaaaagaaaattgtaacattagcatggacaaacctggcaggtactccttaactctcctaagtaataaaaactgtaaaatgcaaataagccttcgatgacctttactaacctttactaaagtatcagtgatgacttggttgtttaaacagctgacatttgggcaatttgagtatgtcaaactcaataatactggttttcatttgcaagatccacttaaaacttaaggaggccaaaaaacatcatttaaaataccctataaattataatcatacatatgatacgaaaaatatcctacttcagtaaatattggaatgttatatattttatgagaaacaattaaaatgtgtaaatagcccagtaataaagttttataatcttttaaatcatcatagaatttttccttaagactttatggttaaatattctcttcattagatgtggcttacccgtggattctagagaagaaagtagatgggagcaagtgtccaatacagcaacagctcagtcaagtagttctggcagttatttgaagtctgaggtttgaagtaggaattcttacgggcatttggggaatatattttctgttgagtcctatactagtaagattttcaacacaaggtgactctcgacctcaccttgtaggaagagtgctgagaaaatatttca

SEQ ID NO: 406898 - DNA, 2244 bp, Homo sapiens
cctcatcactgtcaccttagagcattagagcctctataggtgctccccaatctctgccctccccacccatggtggtactggggatgcagacagaggaggggcactgcataatgctgagagggctggcaccctctctaggtggaacacaggtcatttgtaaagttgtaggtctgccaagcagtattggattcaacacatcttctcaccttctctttccagcgaccctccagggtgccccgactcactttccctgcagatggaggcaaggaggctccacagacaacccccctgcctgaggtcagatagtggccagcaggccaggtactgacaaactgcccctgaccaggttcccagtgatgaagtgatgagacccctaatgaccactcctccattgaccaagtcccactgatcaagtccccacttgaccatgtcttcctaaccaggcccacacttaataggcctcatgggccagaccccactgaccaattttccactgacctggtccccattgacaagacagggttcccactgacaagaccacaatttaccaggttgctgctcaaccgaccccccactgaacaattctccatgaacgagtacccagctgactgagccccctctgaccaggccctcactgaccaggccccaagccactaaggccccacactgaccaggcccgtgatatattgtgtatgccccaccaaccagtttttcattgtttatgttccaacagatcaggccccactaataaagccaccactgactaggtccccccactgaccaggcttccaatgactaggtcaccaggtccccactgaggaggccgccactaaccaggcccctgctgatcaggtcccaaatgatcaggtcctgatgaccaggtcatctctgaccatggtccactgaccaggccccagagcaacggggttcaaagtctcattacaatgtccccctcagctcatagaccctccctccctgcatgtgtgcccggaggtcaggccctggggtttttttttgggacgtggcctttcctccaagacacagggagagacagttggcctcaggctccaagttcccagctccacactcaccccaaaggccctctgggcccgtctcaaaggagaaagtgaggtggcctgacactgcctggacaccaccatctaccctattctgagttttcagagtgtgaggaagggagggaccatttggcagataaggcacgctgtgctgttgggtctctcagggcccttcccacagagccccgatctaaagacacaacacagaggctacaggaagacttaatccagaacctctgagacagccagggaccacatgagtactctccccagacagccagaaggccctttgcttagtttcttggtacttcagtggatgtggcagtggttcttctgttggggaccagtgagtacacactggggagggctcacctgtgtttcctcagtggctccacctctgcttctaaaaaaaatgactcattccagagctggcgcagagaaaatacaagctgagcttagaacatcttctgccagaaagtaaaaaagtgccgacagagtaatggagacaaatcaaagagacataaagtcagcttggaatgtctactactggcctaatcttggggaattggagcatcagaatcatgagctttctttctcccttatttattggttttatttctccatgtagaacaaagaagagaataagaaaataatcatctggtaaccatcatagtaataattgttcaaacacaagtcatccatgaaatgctaaatctagtgggttctgaggagtaaccagatatttacagagcctcaaagtatctccatacaaaatacggttgaactacaaaaagaaaattgtaacattagcatggacaaacctggcaggtactccttaactctcctaagtaataaaaactgtaaaatgcaaataagccttcgatgacctttactaacctttactaaagtatcagtgatgacttggttgtttaaacagctgacatttgggcaatttgagtatgtcaaactcaataatactggttttcatttgcaagatccacttaaaacttaaggaggccaaaaaacatcatttaaaataccctataaattataatcatacatatgatacgaaaaatatcctacttcagtaaatattggaatgttatatattttatgagaaacaattaaaatgtgtaaatagcccagtaataaagttttataatctttt

SEQ ID NO: 406899 - DNA, 463 bp, Homo sapiens
tcaatttctgtgagcttagtaagcacttcagacttcctcagtgaattagtaaggatgcttatccacttacccaggcatgatggtctgtacttttcctctgtccactcaggaatttggagcccttttttgtacttgcaaaataatttatacatcagagctcttaacccagacacgtgaattatgtacgttgtgttccagccactccaagttcttttcttctgtctatacctttggtccttaagaaccaaagcttgctacctcctagccccttttctgttaagaactgccatgcagaagtctacattcacactgagacttctttcttgaatttggaaaaaaaaaatctgctgggtgcgatggctcacacctgtaatcccagcgctgtggaaggctgagaggattgcttgatcccatgagtttgagaccagcttgggcaacatagtgagaccctgtctctaccaaa

SEQ ID NO: 406900 - DNA, 634 bp, Homo sapiens
tgaaaaagtgcccatcattattggtcatcagggaaatgcaaattaagtcacaataagatccccaaaacagcctctagaatggctaaattgaagagatggataaccctgaatgttagcaaggttgtcaggaatgcaagttctcatacattgttggtggcaatgaagatggtacaaccacttgaatagtttgacaatttcttaaaaagttaaatatgaatctgccctatgattaatctgtgatggaaatcagagtagtagcaggatctggttgctcacacctgtaatcccagcactttgggagcctgagatgggaggaggatcccttgagcccaggaattcgagatcagtcttggcaacatagtgaaatgacacctcttctctacaaaaacaaaaataaaaaaattagctgagcatggtggcacacaactcaagtgggaggatcacttgagcctgggaggtggagcttgcagtgagccgagatcacaccacactgtactccagtctgagcgacacagtgagaccctgtctccaaaaatagctagctagctagctagatcgaggttttctatgggtagaggccaggagtttgagaccagcctgggtgacacagtgagaccctgtctctaccccccca

SEQ ID NO: 406901 - DNA, 638 bp, Homo sapiens
tgtatatcgatgcaccctgaagatatgcgattccttacctctcaatagtgtcactgtttctaattcatggtaatggggatggggacttaacagcaggtaattagagcaatggcagaattggctactgaattacaatggcagattcctgagaatggaagaagtgctgcccaggaatggagttcaacagatcctctccacacccgggtaaacatggcatttcgcagcacctgctgtggtccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagatttacttacgattcttggactatgagatgcagaattcaaatgagtgcaagaggaattttgtggctgtgtatgatggaagcagttccgtggaggatttgaaagcta

SEQ ID NO: 406902 - DNA, 759 bp, Homo sapiens
agcgtggggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctg

SEQ ID NO: 406903 - DNA, 495 bp, Homo sapiens
taccttctggcccctctcttcattcagagatgctggcagagccattccctaaggttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctg

SEQ ID NO: 406904 - DNA, 523 bp, Homo sapiens
taacttatacaatcaaaaaaatctgatggctgctggaccaatttaaaaccagacagaagccacatggtaatgcccctgaagattgtagggcttagattatagtaaaacttagattatagtaaaaaggagttattttcttacaataaaggcatagaaagcttacattttgaggaaatgacaaaatatctaaccaatcttgagaagcattattatttctagatcacacagcttttaaaaaaaggaagttttgttgggcgtggtggctcaagcctgtaatcacagcactttgggaggctaaggggagcggatcacctgaggtcaggagttcaagaccagcctggccaacatggtgataccccgtctctattaaaaatacaaaaattagctgggcatggtggtgtgcacctgtagtcccagctatttgggaggctgaggcacaagaattgcttaaacccagcagaggctgcagagagccaagatcgtgccactgcattccagcctggttgatacagtgaaactctgc

SEQ ID NO: 406905 - DNA, 1035 bp, Homo sapiens
gcggccgcattggccttcacggggtccacggggtgccgcagcatggccagcacctcaggcagctcagggtcccgccagcgcggctccttgcgggcgctatccactgagggcgagcgccgcaccagccggtccaggctgcccatgctgccccgttcaggctgggccaggggcgccgtcaccattgggaacgcaggccgctcgtccgccagctcgccgccatcatctgctgtgtcctcgtaggccctgcacaggcaagtggggcgcgtggacatcgtcacaggcagccgccagccctgcctctgagctgccccatcacaccttcttcaggactgcaaactcacccagcagcgctgggctgagagcacctgtatcttggcccggagcatggtggggacacagagagtcatgcaccagcccagtgagaaccaattcagagccaaatgccaaaccccagccagcggctaccaggacccaggcaaccctcccaggacagcaaactcactcactgctgtcaccgggcagtttcccaatcccgagcaaaacaagtttctgtgagacatctgctatggctgctggagagaccgtctcacctcccttccacaaaaccaccccatcttccatgaggcccatctctggctgtgccaggatgtagggggagtaaatggccctctccgcatgaagccatcccagtaggaccacctgaggagtattcaggccaccagccccttggggcacaagatctccttagctctcagtagccctgtgggttgctgtcatcaaaccgcctgccctgaggctaggagtgacggtcaggtgacttggccagggtcacacaacaaaatcctgacccgggctgtggtcacatccccactccagagatgcagaaactgagggcaatggggacagaaccaggggctgtgacaagggccagggctctgggttctggttacccagagtgtggctggagcaaggccagtggccggcactcttcccagctttcctgggccctgggcctgcaggacagtgcccagccga

SEQ ID NO: 406906 - DNA, 813 bp, Homo sapiens
ggattctgagactgaaaagtttgagaaaaacaaatggaaagagatgactgcaggacttatttgagtccgttacacattcccatgcaggggaatccaggctgtgctgtttcccagttgtgtttgctggtgagaacgttttttcaggcaggcaagtctgctcggaatagtgttctttggaacatactttgggaaatgctgacatgatggttaagagcgctggctttggtgtcagacccagattcaaattcttgctctgacgcttcctggctgtgtgatttttgacaagtcacttaacccctctgagcctcgatttcctctttctgtcaaatggaatgatcatagtactttcatcttaaagctgttgtgaggattaactacgagtgaatgcagtgtttcccaaagtgtgtacattcagcgtcagtgatatatgggatgatttcaggtcttacgtgagtaaactttaaaaaatagtcctgagttagcttttgtgaactttagaaagctgagtgtcatgcctcagccccttgatttcacacgcgattgcttagggggaggctaagttaaaaaaaaaaaaaggaaattgagttcttaaaagaagccattgatgcagttcagatggttactttgctgggcagcagtggggaaggtggcgtggaatgttggagacttggattagcttttaaagcaggtgccagcacttggcctacagcaggtgcttgccacagggtaagaactattgacacttactattgatgctctattttgtcaccgtcattgtcattgttattattgagaaaactaaggctcagagag

SEQ ID NO: 406907 - DNA, 1108 bp, Homo sapiens
aactctacggcctagcaaccgttgccaaggagctcgactctgggagcggtctagagcccgggcgcctcctggggggtggggaaacggtttcgtgaggagaatttgagttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgat

SEQ ID NO: 406908 - DNA, 3048 bp, Homo sapiens
aactctacggcctagcaaccgttgccaaggagctcgactctgggagcggtctagagcccgggcgcctcctggggggtggggaaacggtttcgtgaggagaatttgaggtaacctcgccaactcgcggtcggaagctcctctgaaccccgaaataggagagagctcccgtcctctctcggtcctgatgcagcacctcgcaagtggaaggggtcgtcgcggttaagcccccggataggggaatcgggccccttctgggattcgagcggatccaggccgctccctggagggatgaactgtcgaggggcccagggcagcccccgctagaggcccggtcgggtgtggggtcccctgtcccctgtcccgagcccggggagggggacactatttctggtactcccaggaggctgcgggtcgatgctcgtgccagcctgggacccaggcagcacggtttctctcccaaattgtgccagagaacacgcacgtcctggttttcattgttccccgcctcctgcgactcgtttgtggttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagagacaggatctcactctgtcacccaggctggagtgcggtggtgtgatcatggcttactgcagcctgaaactcctaggctcaagtgatcctcctacctcagcctcctgagaagctcggactacaggcacgagccaccatgcccagctaattttctttttttgttttgttttgtagagatgtggtctcactatgtttcccaggctggtcttaaactcccggcctcaagcagtcctcccacttcggcctcctgaagtgttaggattacaggcgtgagcctgcgcctggctgtaattactatacccagtttttacagataaaggatctgagacatgcagaggttttaagctgacttgcctgacaccccattgctagtaagtagtagaaccaggagttggatttagcagtctggctgtagagtcatcaatagtttgcacatgacagaaagctggaagaaatagtcaacctgaaacacatgatggaattataattcagaatcatcttggtagataggggcactgtgcttaaacaaaatgccattaatgggattataataaatataatgtggtagaattcaagttttgtttgccaattcaacacatcatctgttactaacgcagctttaaaaaatgcataaacgattatactacattaatttttttaaaaagtatcctgtttatggtctgattatgcctggagtattattttatatttttgacttcatgttttaagagacaatcatgccagagtcccacatgagggtgactaaaatggacaaaaagtctggaaactttcatatcaataattgattatgtattaactgaaacaaaagactagagaaagacacagtgggaattgattatgtattaactgaggaataaaagactgaagaaagacataataaatagttaaaggattatggaaaagatggtgttcagaaaaaaattaacatgcaggcctgagactgctatccctagaaaggtctgcttgcaaagttggcccttggctggcatctgggggaacttggttcttggatggattcctgccattcactgataagaatggctcaccttgcctaaagtatatgaagagtgtgctttatgtcgagctcctgcttgcttgcctctttctttgtctttctttcttttccttcctcccttccttccttccttccttccttccttccttccttccttccttccttccttccttccttcctctctctctctctttctttctttcttctttctggaattttggtacaggctaggcagaatgtgcctagatgatcagctcctagtaaaaaccttgagaact

SEQ ID NO: 406909 - DNA, 2540 bp, Homo sapiens
aactctacggcctagcaaccgttgccaaggagctcgactctgggagcggtctagagcccgggcgcctcctggggggtggggaaacggtttcgtgaggagaatttgagttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagagacaggatctcactctgtcacccaggctggagtgcggtggtgtgatcatggcttactgcagcctgaaactcctaggctcaagtgatcctcctacctcagcctcctgagaagctcggactacaggcacgagccaccatgcccagctaattttctttttttgttttgttttgtagagatgtggtctcactatgtttcccaggctggtcttaaactcccggcctcaagcagtcctcccacttcggcctcctgaagtgttaggattacaggcgtgagcctgcgcctggctgtaattactatacccagtttttacagataaaggatctgagacatgcagaggttttaagctgacttgcctgacaccccattgctagtaagtagtagaaccaggagttggatttagcagtctggctgtagagtcatcaatagtttgcacatgacagaaagctggaagaaatagtcaacctgaaacacatgatggaattataattcagaatcatcttggtagataggggcactgtgcttaaacaaaatgccattaatgggattataataaatataatgtggtagaattcaagttttgtttgccaattcaacacatcatctgttactaacgcagctttaaaaaatgcataaacgattatactacattaatttttttaaaaagtatcctgtttatggtctgattatgcctggagtattattttatatttttgacttcatgttttaagagacaatcatgccagagtcccacatgagggtgactaaaatggacaaaaagtctggaaactttcatatcaataattgattatgtattaactgaaacaaaagactagagaaagacacagtgggaattgattatgtattaactgaggaataaaagactgaagaaagacataataaatagttaaaggattatggaaaagatggtgttcagaaaaaaattaacatgcaggcctgagactgctatccctagaaaggtctgcttgcaaagttggcccttggctggcatctgggggaacttggttcttggatggattcctgccattcactgataagaatggctcaccttgcctaaagtatatgaagagtgtgctttatgtcgagctcctgcttgcttgcctctttctttgtctttctttcttttccttcctcccttccttccttccttccttccttccttccttccttccttccttccttccttccttccttcctctctctctctctttctttctttcttctttctggaattttggtacaggctaggcagaatgtgcctagatgatcagctcctagtaaaaaccttgagaact

SEQ ID NO: 406910 - DNA, 483 bp, Homo sapiens
gggaaaaaaaagttgttgtgaggattcagtgagctcatgcatgtcctgaatgttattaggtgttaccactagaggaaaggttgtgtgtgaaggggttttagcaatgagggcaggttgaacaataggtgttgttgactggaatcattcgtgtggatagcatggatctctgtatttcctcagtgtagaatagaatgacccagggctggaggtacccatgtaggtcttcaaacctagaagttgattgccatcaaatcctgattcttttttagggcaaaggtaaataattaaaatctcttgtgcaatacattttgaatacttaagaaattaaaatttaggcagaaatttaggaaagtggtttgctcccaagcttgttataagatcttgttataagctagttataagcttgttataagatcagagctacttctccacacttaaattgttttatttaacacctctgcctagtcataaatatattttttc

SEQ ID NO: 406911 - DNA, 464 bp, Homo sapiens
ctggacccaggatggggctgaactgggagaggtagctgtggacctgctcctcgctctgccctcaccctaagagctgatggggcatccaccaggaagagcattcctgggcagggagagggccatgagcagccttgtcctgtatgtgagacacagctcagcccggtcacaagatccagatgactatgactgcaattcaggggaagtagagaatgaagattgaccagaataaccctctgggaatgtgccctgggcctcctagagggaagagcttcccttctattcagcgctgcaggatccacagaggaaggagagccctggccaccagggaggagccacatgagaggacccggtgtccccacaaatgggaacggtcctgggcccagtctgtgctgacgcagccgccctcagtgtctggggccccagggcagagggtcaccatctcctgcactgggagcagctccaac

SEQ ID NO: 406912 - DNA, 963 bp, Homo sapiens
tgctggaattacaggcatgagccactgcgcctcaccacatttctctttttgtaagatgagggaacaagtctttatgattttctaggacctctctgggaaatcttaggcataaaacacatcctaaaaattttattttttcaaaacagaggttcagtttggaaaggcaaaaccagagttgtatacagtaagaccttcttcttcaaagggttcccttgtcctttgttccctgctttcaaggccagactctcttactctctgtgttcccttgccctgggaaacaaccttcctctcagtctttatctatagagcccacattccacatctgctactcactctgtaaatcacccctcccatcacaacgccccctcccccgactgccaaaactgtttttccaccggtgtaaccacatccctgcacttctcaagttagccaaccgtgttcggcttagattgtgctgtccaactctagccagtggggactggacacagcagtaggagccaacgcgttagtgataaagctgctgctttcctttgttggatgtgctcttgtgatcagactaatgagcagcacccttctgcagaagtaaactttgccttgctgagaaatcaactattggagtgttcatttcatttgtgacttcgagctttatttctaacaagagttgtcaagggaattttaagtagggtaagacaggagcacaggtgtttaagaagcaatgtctggttatataatcaaagcggtaaaacatttaaaaataaacatagatgataacacaattttaaataatttaaaattcttttcacacgtgagtactccttgttctctctctctcttttttttttcttaagagcattaatcaagtcaacataaagcactgaaaataattctggtgagacacagaatgtctgctagctaggcagattccacagaaggtaaagaacatcctttcacattgtaggcatt

SEQ ID NO: 406913 - DNA, 479 bp, Homo sapiens
aatgcgtagatttagggagctgatgagtttggtcctagttcttacccatgatgcttcaaacaaagacaacagggtgagctttgagggcttccaagtggatgtccttaggacagtccaagtgaagcagctgaactactccatcgggagaaaattctgcacagaaggaaagttacaagtgcaagtttccatgggcacatgaggctcagaggtggctcaaggccacaggaggctccagaggtccccgcaaagaaagccagctgctctagctccacttcctgcctggcggttctgagatttttagttcttatcctgaaatattaggctatatccgtcgcaccggaagaacaagttcctgcttcatcacagaacaggcactctatatttgctgcagcgagtgaactctgggcaagggtacagaaaagaggtgcacagaggcctgtttctagtaacacaggctggcctcctgttgaagacatgag

SEQ ID NO: 406914 - DNA, 391 bp, Homo sapiens
ggatattatataaaaatatccttgaaatggaaaattactgaacacactttaaactttagatataatgtaaaaatattaatatcattgtgcagccatgtcaaaattttttaatcagccagtaaggtcaaatattctaaccgtggaggcagaggttgttttaagagcctgtacattggagtcagactgcctgggattgaaccccatttctacaaattaaccttctgtatgcctctttttcctcacttgtaaaatagaaaacaatgataacatgtctttctcagtaattttgaggattaaatgaatttacatatatataagcacttagaatagaacttgacggagagtgttatttaaatgtttgttttcatttgtcacaaaatctaaaataaaa

SEQ ID NO: 406915 - DNA, 405 bp, Homo sapiens
ctaaagcccagaagacagaccagtgcaccggatgcccgtaccgcgtgatggccaggaaggcccggctgtgcagctcctgcttgatggcgctttgcagacggagccagtgaccaccgaggctgtgccactgcatcgggccaccatgctgatatgcccggtcccagagctgctagagaagaggtacagaggcagcgaagacacgttgagggggaggacgagaccaactgcgagacgccgagtcccgggctctcaggacgctctcccgtacctgcgccctcgtcagcccatcaccgaaagaacggcctgacccagggtcacactgcagactttgcagtgagccgagatcatgcgactgcactccagtctgggcaacagagactccatctcaaaaaaataaataaaaat

SEQ ID NO: 406916 - DNA, 805 bp, Homo sapiens
ctaaagcccagaagacagaccagtgcaccggatgcccgtaccgcgtgatggccaggaaggcccggctgtgcagctcctgcttgatggcgctttgcagacggagccagtgaccaccgaggctgtgccactgcatcgggccaccatgctgatatgcccggtcccagagctgctagagaagaggtacagaggcagcgaagacacgttgagggggaggacgagaccaactgcgagacgccgagtcccgggctctcaggacgctctcccgtacctgcgccctcgtcagcccatcaccgaaagaacggcctgacccagggtcacactgcactgaatgcttcctgttttgctgtctctcggaggataaaagacactcttggctgggcgcagtgtctcaagcctgtaatcccagcacttcaggaggctgaggcaggaggatcacttgagctcaggagttggagacagtgagaccctgtctttacaaaaaattaaaaaatgacctagcctcaacttggtcaggcgtggtggctcacgcctgtaatctcagcattttgggaggctgagatgggtggatcacgaggtcaggagttcaagaccagccaaaaatggggtatttaaaaacccgcccataatttctcactgctctgagaccaagataaaaacgtggccccggccagcctcacacaggagcctttctgctcctacaaagccccatgagcctgctccctccctagagggaaggttctggggccctggggatcccatgaggctctttccacagacaacagaggttcagagaagtgaagtggtg

SEQ ID NO: 406917 - DNA, 441 bp, Homo sapiens
tgtaatgacaaggtttcaccatcttgcccaggctggtcttgaactcctgggctcaagcaagcctccctccttggcctcccaaagtgctaggattacaggtgtgagccaccgtgcctggcctcaagtgttttttaaaaacaaataaggaaacaggtctaactgggaaagtgtcttacacaggatcacacatctagctagaggcacaggggagaccttcaagtctgagccaggacttaccacccattactgcttctatcaggtccaaacagcctggcagtaatcctcttgaaaatgtttcctaattgtccataaaaccactctgataataggttctgctttctctcctccttggccccttagctttcttcaacatagacagctccctttcctgacaagctcttcatgaagctatttcacgagactgaaacccttacctgtttc

SEQ ID NO: 406918 - DNA, 497 bp, Homo sapiens
ccatgaaggacagagacgacaaaggcaggtggaatagatagagaagagattcaaggtctgagctctacattactcaaactgttagagattaggaagaagaggaagacctggcaaaagaatgtcctgggatgtagaaagaaaaccagaagcttgtgttctctggaaaccaaatgaagaaagggcttccagaaggacagacaaagtgtagtgtgtcaaaggctcctgagcaatcagaggagagcacaaaggggctcacaggactttggtatctggatcacccagtgacacttcctgatcatgagaaactgtcagaccaacaggggcactttctgaaaccagcagttcttcagtgcccaaatgcaaccttgatggtttgattttggaggatggcaattcattaacagcactccccagtgataaatatgaaaaccaataaaaccccccacccaaggcaatctctcccagctcctcgctttgagtaaagtgagtaacctcca

SEQ ID NO: 406919 - DNA, 439 bp, Homo sapiens
gcggccgcgccgcagaaggtgaaggaacagcgcgaggcacgcagccgccgcaccgtggcgcgcacgagctcagccggccggcgaccccagcgcgcccacaggacagtggcagccggaaagtgggttcctgcatggtaacaagaccttaaaattgtgtcactggagaaggacgtgcagttcccgctgaggagagacttggccactccaggacaacacaggactacaagtcaggaatttgaagatgaaaagtgctcaacagtgataaatcctaaatgtttcactgaacaacctttcagatagccttcttgaagtttgctgaattatggctataaggaccactccccacccctgctaggtatggagaggtcatctcctaggttgcagtgagccgagattgcaccactgcactcaagcctgggtgacagaaaaagactccatc

SEQ ID NO: 406920 - DNA, 583 bp, Homo sapiens
ggaaaatggataataatgaagcccacagattttcactccagaactgactttgctgcagaggagtgaggagagctgcctggcaacgcaacgcatcgctgtgcataaactttgtttacagccaaggctggagtaaaggaacagatggcaagaaaatcggatttaaagaaaggaaggatgtgcttgcatctgggagctcggtaaatctcttggcttctggtgtgcgtacaagggtgacgtctagctaccccagcagtcgcgtcccagtttgctgttgatttttgcctgtttggatctgtctctgaggatggttaatacatcttattacaagcatttatctcatccctcccacaggaaatgtgttttcccagggatttgtatgttccctaaccttttatggaaagcagtttcttgatcatccatgtgattgtgtatctaaaatttcaagaatatttaagctgttaatcctgcttgtctgtagaagatgggtttatatttctatgatcttggaaatatttacaatgagcatgtataacaaggagaaataagcataaacatttatgcctgccacattcgtaagcatgct

SEQ ID NO: 406921 - DNA, 511 bp, Homo sapiens
  misc_feature (510)..(510): n is a, c, g, or t
ctaatttttgtatttttagtagagacagggttttatcatgttggccaggctggcctcgaactcctgacctcaagtgatctacccgccttggcctctcaaagtgcagggattataggagtgaacaactgtgcccaggctgtcttcagcatattttctattactcaagaataagaactgtacactctacctaatgtggactacattccctaccttggatacacattttggctccacacttacattcatgctattccctttacctagaatattctttttcttttcacacttaaaaaaatttcttctggtgaaatcaaactgtctctctaataccatatccacatataatcatctccctgaggttttccctaatcatccttgttctctgttcctaatagtttggtaatgcttaatttttattactccagggttactgataacataattgtatttagggtacttattttaatacacatcttacgagtgcaatctggggatcctgctagagatcgnc

SEQ ID NO: 406922 - DNA, 538 bp, Homo sapiens
tactccagggttactgataacataattgtatttagggtacttattttaatacacatcttacgatactcagcaaatgtttgttggcaatcataataaaccagaaagtgctaaatcaattagtatctttagtgttcttatattaaaattgaaataaggatattaatacattaatataatttaaccacaggaagcagggtggatagaaaagagcttagattttagaacctatagagttcaagtactaacgtcactgtgtactagcgatgtgacttctagcaagtcagcctctttgtgcctcagtatcttcacctataaaacgatgcattatttgaatttaaaaggattatgaaatttaaattcaatttttattagctttcctccctcttcgtgatagaattttatggcttactcctttacagataacaccaatgggcgtgaaatctactataaagttcagtgatatatcctaaacattcaaatttaccttacttacaaattgtggccattttgtctgttttaataaatagatttctacatt

SEQ ID NO: 406923 - DNA, 366 bp, Homo sapiens
ggattacaagcaggtgccaccaggcccagctaatttttgtatttttagtagagacagggttttatcatgttggccaggctggcctcgaactcctgacctcaagtgatctacccgccttggcctctcaaagtgcagggattataggagtgaacaactgtgcccaggctgtcttcagcatattttctattactcaagaataagaactgtacactctacctaatgtggactacattccctaccttggatacacattttggctccacacttacattcatgctattccctttacctagaatattctttttcttttcacacttaaaaaaatttcttctggtgaaatcaaactgtctctctaataccatatcc

SEQ ID NO: 406924 - DNA, 460 bp, Homo sapiens
gccatcaaactccaaatggtcgtgcaaccggagcctcggaagatggcgccttctgccgggaacccttagataggcttctgagggagctctgactgccgtttcccaaaacaccgctccctgttagcaggaagcagtttagatcggtcttcgtcctcacccctatccttgttctaacagtagtttgatgtacttcttgagaggggggaatgagacagccaagtgtaaaggggtccccagagaacctctgacaaacccgcacactgggaggaatgtgcactggggtggagcctctggaagttcgtgctgaggagcctggcccctcctcttccagggtggaacctgggattcaacctgagaggtgggaagcgtgtactagcaggactctcactctgccgagggtccccgtttccccgctttttttttttgcccaataaattccatttttctcacccttcaaagt

SEQ ID NO: 406925 - DNA, 1547 bp, Homo sapiens
cggccgccctggggacgcagacgccaaggcccctccggccagggccgggagccgggccggcctagccagttctgaaagccccatggccccagcaggcctctgagccccaccatgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgccttcatcacgctctcggcctctgtcttcagcctcctggccatcgccattgagcgccacgtggccattgccaaggtcaagctgtatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggcggccgggggtgggggtgcaaggacggaggcgggtcgggaccccgggccaccacctcctgccactccgcagctccagctccctggagaggggcatgcacatgcccacgtcacccacgtttctggagggcaacacggtggtctgagggtgggggtggaccaacaaccaggccagggcagaggggttcatggagaggccactgggtgaccccagatagagacgtggggctactgagccagatgcccccgccccacagacctgggtgatgttgcaaatatttcacacctggaaaggccagataaggcactgactagtcacatagcagtgttgcagtgcggtcctgagggccagtccagtggctagtgtgacccctttagaactggatcctggggaggccagggcaggggacctgtgaagagccagggtgagggcaggcagcatttaaggggagctcagggcaggagcactttaccacctggtacaaaggatttttttttttttttgagacggaatcttgca

SEQ ID NO: 406926 - DNA, 868 bp, Homo sapiens
cggccgccctggggacgcagacgccaaggcccctccggccagggccgggagccgggccggcctagccaggtgagcgcgcgtggcgacaaggaggcagaaaaggcgggcctggtcccctgaggtctcgggatccgagctgaggggccccaatcggggggctggggcgcgcacgcgccgcctgggttcctgctgcacggagcgggtggtcacagtgcgccctctccaagaatccgggcggcccccactgcctcggccgcgaacccgcagactgtgctccccgcctttctcagcggcaggaagttggcgccggggagaaggctgaatccgagcgctttcgactggagtctttgggaggcaggacgccgtgctcggggaccggggtcttggggagtgtgtttgggggggggcaacacccctcctggctgactccggctgagcgagggcaaaaggatgtgcgcgccgtggagcctccaagccaaggggcggcacccacgggagggcggtcggacgtcgggctttctgcctcggtttccccaagttgtttgcctcctccggtcccccggcggggggcgtggctttgttttgtaaggaaagagaaagtgactgcgtggctcagacgcctcctctttcaactccggctcagggatgggtcgtgggtgaaggcgcgcgtggcgcggacctcgcgtggccccgagccgggcggagcgtcggaactcgcccccttctcaggcacgggttgactcacccggggatttccaccccctcctctgtctctgtccttgtcagatgctccgggccccacgcgctgagcccacagtccccctcgtggggcgacacggccaggcgcggaactcgcggtgcagctgct

SEQ ID NO: 406927 - DNA, 740 bp, Homo sapiens
cacttagtaggaatttatttgttgggtggacacacagtaggcacttaatgcctatttgctgcgttgacacctagtaggtacttccaaggctctttgttgagtcaataaatgtgacctcgtgttttcttccaagtccagggtcccaggggtaagcccagaggtaacctggggttgaagacagttgtttcaggttgaggccacctggccaggagtactgtgacgtcaccaggctgcgtgacgtttcgcgccggccggttctcacgggtgggggctgggaggggcagagtgagagatcgggtggggggggcggacaaagggccctccgtgcagctcctgtcggcccccgcccaaggggcggcacccacgggagggcggtcggacgtcgggctttctgcctcggtttccccaagttgtttgcctcctccggtcccccggcggggggcgtggctttgttttgtaaggaaagagaaagtgactgcgtggctcagacgcctcctctttcaactccggctcagggatgggtcgtgggtgaaggcgcgcgtggcgcggacctcgcgtggccccgagccgggcggagcgtcggaactcgcccccttctcaggcacgggttgactcacccggggatttccaccccctcctctgtctctgtccttgtcagatgctccgggccccacgcgctgagcccacagtccccctcgtggggcgacacggccaggcgcggaactcgcggtgcagctgct

SEQ ID NO: 406928 - DNA, 1231 bp, Homo sapiens
cggccgccctggggacgcagacgccaaggcccctccggccagggccgggagccgggccggcctagccagttctgaaagccccatggccccagcaggcctctgagccccaccatgggcagcttgtactcggagtacctgaaccccaacaaggtccaggaacactataattataccaaggagacgctggaaacgcaggagacgacctcccgccagatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggcggccgggggtgggggtgcaaggacggaggcgggtcgggaccccgggccaccacctcctgccactccgcagctccagctccctggagaggggcatgcacatgcccacgtcacccacgtttctggagggcaacacggtggtctgagggtgggggtggaccaacaaccaggccagggcagaggggttcatggagaggccactgggtgaccccagatagagacgtggggctactgagccagatgcccccgccccacagacctgggtgatgttgcaaatatttcacacctggaaaggccagataaggcactgactagtcacatagcagtgttgcagtgcggtcctgagggccagtccagtggctagtgtgacccctttagaactggatcctggggaggccagggcaggggacctgtgaagagccagggtgagggcaggcagcatttaaggggagctcagggcaggagcactttaccacctggtacaaaggatttttttttttttttgagacggaatcttgca

SEQ ID NO: 406929 - DNA, 124 bp, Homo sapiens
ggaaaggaaactacactgacattttagcaaaattcagacccctccaataatactaatgctatagcttttcattagtaaagaggggttaggtttagggagggactattatcatccttgcttcaaa

SEQ ID NO: 406930 - DNA, 436 bp, Homo sapiens
aacccaatcctcttatcacaacaattaaaaacagggaagctgaaagccaccgtggcccacccaaactgcacctggtcaccttgtctacattcagatttagatgaaagccacaccatggaggcagccagaggcccatgggagatgtctggattcgcagaggaatagctccatgtgatgcaaaccttgactaatgggaacaggaaaagggaggaaaccaggaagataaatctccctcccttctcattgctccttgcaacccttcccacttgaagcatgaccacatttaatgaacaacctgctgtgtctcttggaagcttgctgcaaggcagcaatcagcacaataacattgtattgtatcttcctctgcttcacttctcttcctccctcaccctcactgccctgagctggcacatcccaaagaaagcattaccacatt

SEQ ID NO: 406931 - DNA, 916 bp, Homo sapiens
accctcagaacctagctttcctgcctgcccccagggctaatccagaggtgggggaggggctaaagacactgggctctgccaggggccttggatgagcttatcatggaacataagaaaaataaaacagatgtcagcctgtgtatgaagaattcatccacaagatttgagcagaccgaagactgtgagacttcctccccacagtgagctaaaaggacgcttttgtcagagtggggaaataaaagggctttatgggaaggaagataagaacagatgagtcagaggtttctgcttaatggtggtacagccaagcagacaggcaagtaagtggccatactgctactgcctcatgtaggatccggcaggctggtgggttatcagtcctcacgtgggaccctcccaccatggcagctgagcacatccaagctgggggatcctgaagagaccttcacctgggtgccacgtggaagattggccagcaccattttgactcctgtggatgggtgagtgttttgcccacccccaccccaataacatcagcacccaaactgcacctggtcaccttgtctacattcagatttagatgaaagccacaccatggaggcagccagaggcccatgggagatgtctggattcgcagaggaatagctccatgtgatgcaaaccttgactaatgggaacaggaaaagggaggaaaccaggaagataaatctccctcccttctcattgctccttgcaacccttcccacttgaagcatgaccacatttaatgaacaacctgctgtgtctcttggaagcttgctgcaaggcagcaatcagcacaataacattgtattgtatcttcctctgcttcacttctcttcctccctcaccctcactgccctgagctggcacatcccaaagaaagcattaccacatt

SEQ ID NO: 406932 - DNA, 1256 bp, Homo sapiens
accctcagaacctagctttcctgcctgcccccagggctaatccagaggtgggggaggggctaaagacactgggctctgccaggggccttggatgagcttatcatggaacataagaaaaataaaacagatgtcagcctgtgtatgaagaattcatccacaagatttgagcagaccgaagactgtgagacttcctccccacagtgagctaaaaggacgcttttgtcagagtggggaaataaaagggctttatgggaaggaagataagaacagatgagtcagaggtttctgcttaatgctcactcttcaattctttcccgagcaaaaccaagaatcttcttgggctaagccccaatttggggttcacctgccttgcagcaacatggcaccaaacatgcggcagaagagagaaaacgacagcatgagagacggagaaagaaatggccagttggcaaggtggtaatgagagacagcagttggcaagacagtgagagacagcaagagatggcaagtgacagttattgttaagatgacaaatggagagatggcaagaaatagagaagcagtcagtgatggaggctgcaagagttgtaacactaaccaaaggctctttttagaatcatcgttttccctggcaggtggtacagccaagcagacaggcaagtaagtggccatactgctactgcctcatgtaggatccggcaggctggtgggttatcagtcctcacgtgggaccctcccaccatggcagctgagcacatccaagctgggggatcctgaagagaccttcacctgggtgccacgtggaagattggccagcaccattttgactcctgtggatgggtgagtgttttgcccacccccaccccaataacatcagcacccaaactgcacctggtcaccttgtctacattcagatttagatgaaagccacaccatggaggcagccagaggcccatgggagatgtctggattcgcagaggaatagctccatgtgatgcaaaccttgactaatgggaacaggaaaagggaggaaaccaggaagataaatctccctcccttctcattgctccttgcaacccttcccacttgaagcatgaccacatttaatgaacaacctgctgtgtctcttggaagcttgctgcaaggcagcaatcagcacaataacattgtattgtatcttcctctgcttcacttctcttcctccctcaccctcactgccctgagctggcacatcccaaagaaagcattaccacatt

SEQ ID NO: 406933 - DNA, 1390 bp, Homo sapiens
accctcagaacctagctttcctgcctgcccccagggctaatccagaggtgggggaggggctaaagacactgggctctgccaggggccttggatgagcttatcatggaacataagaaaaataaaacagatgtcagcctgtgtatgaagaattcatccacaagatttgagcagaccgaagactgtgagacttcctccccacagtgagctaaaaggacgcttttgtcagagtggggaaataaaagggctttatgggaaggaagataagaacagatgagtcagaggtttctgcttaatgctcactcttcaattctttcccgagcaaaaccaagaatcttcttgggctaagccccaatttggggttcacctgccttgcagcaacatggcaccaaacatgcggcagaagagagaaaacgacagcatgagagacggagaaagaaatggccagttggcaaggtggtaatgagagacagcagttggcaagacagtgagagacagcaagagatggcaagtgacagttattgttaagatgacaaatggagagatggcaagaaatagagaagcagtcagtgatggaggctgcaagagttgtaacactaaccaaaggctctttttagaatcatcgttttccctggcaggtggtacagccaagcagacaggcaagtaagtggccatactgctactgcctcatgtaggatccggcaggctggtgggttatcagtcctcacgtgggaccctcccaccatggcagctgagcacatccaagctgggggatcctgaagagaccttcacctgggtgccacgtggaagattggccagcaccattttgactcctgtggatggctaaagtgacccagcaggcttcctgagccttaggcattacctgtcatcttcactcttggagacctcaatcctcagttccaggtaaagacaatccttgcacaaggcttccaactcgacccgcctactgacctggagaatgaaagtgtcctgcctcggggcccctcagatcagcacccaaactgcacctggtcaccttgtctacattcagatttagatgaaagccacaccatggaggcagccagaggcccatgggagatgtctggattcgcagaggaatagctccatgtgatgcaaaccttgactaatgggaacaggaaaagggaggaaaccaggaagataaatctccctcccttctcattgctccttgcaacccttcccacttgaagcatgaccacatttaatgaacaacctgctgtgtctcttggaagcttgctgcaaggcagcaatcagcacaataacattgtattgtatcttcctctgcttcacttctcttcctccctcaccctcactgccctgagctggcacatcccaaagaaagcattaccacatt

SEQ ID NO: 406934 - DNA, 1140 bp, Homo sapiens
accctcagaacctagctttcctgcctgcccccagggctaatccagaggtgggggaggggctaaagacactgggctctgccaggggccttggatgagcttatcatggaacataagaaaaataaaacagatgtcagcctgtgtatgaagaattcatccacaagatttgagcagaccgaagactgtgagacttcctccccacagtgagctaaaaggacgcttttgtcagagtggggaaataaaagggctttatgggaaggaagataagaacagatgagtcagaggtttctgcttaatggtggtacagccaagcagacaggcaagtaagtggccatactgctactgcctcatgtaggatccggcaggctggtgggttatcagtcctcacgtgggaccctcccaccatggcagctgagcacatccaagctgggggatcctgaagagaccttcacctgggtgccacgtggaagattggccagcaccattttgactcctgtggatgggaaaccctggaacagtgtctataagtcatgaaaaacagagcaattgaaatggaatctcacttgggaccccagtcactgctccagactgaccagtcagtggacaaggcttctcgcattgctcaccagcacccaaactgcacctggtcaccttgtctacattcagatttagatgaaagccacaccatggaggcagccagaggcccatgggagatgtctggattcgcagaggaatagctccatgtgatgcaaaccttgactaatgggaacaggaaaagggaggaaaccaggaagataaatctccctcccttctcattgctccttgcaacccttcccacttgaagcatgaccacatttaatgaacaacctgctgtgtctcttggaagcttgctgcaaggcagcaatcagcacaataacattgtattgtatcttcctctgcttaatttttctcttaccttatggctgagtgcatccaaagaaagatacccttaaaaaaaaaaaaaaagggggggtaaaatccggggccattacgtccgtttgaagggccagaggagaaaaaagagggggaaagggggaaaggggtctgagaccctggggaggaccaaacagaaaattgaccgcgggtactctaaataaggtctga

SEQ ID NO: 406935 - DNA, 462 bp, Homo sapiens
ctttgaagccaggcattcacttatctctctagctatcagttctagatgactacttcttccaataggaagttgttttgtctgcactgaaaatgttgagtgtagccaacttcatttacgatcttggctagatattctggataacttgctacttcaccttgcatttttgctatggagatggcttctttccttaaacctcatgaaccaaccactgctagcttcaaacatgacttctggttcctgacctctctcagccttcataaaattgaagagaattagggccttactctggggttacgctttggcctaagggaatgttgtggctagtttgatctcctatagagaccactaaaactttctccatatcagaaataaggctgtttgctttttaaattattcatctgttcactggagtagcacctctagtttttttcaagaacttttcagccagagaatgagaagctg

SEQ ID NO: 406936 - DNA, 533 bp, Homo sapiens
aagtcaaactcatagaagcagagcgtagaacggtggttaccagaagctgggccatgaagggattgggaagatgttgttcaaagggtacacactttcacttataagatgaacaagttctgggggtctaatgtagcacatggcaactatggttaacaatactgtattgtatacttgaaatttgctaacagagtagctctcaaatgttatcacacaaaatggtaactagatacagtgatcagtgtgtgttaactgacttgattgtggtaatcatttcacaatgtatttgtataaaactcatcacattatatatcttacatttatacaatttgtcagttatacctcaataaagctgcaaagaaatatcatttctaggttgtgcccatcacaacctgtaggagttaagatttcagcctgagtttcagtttcaattccaataccactactttctatgtaatactgaacaagttttctaacatctctaaactttaatttcttcctctataatgggaataaaatcaaattattttttcaaa

SEQ ID NO: 406937 - DNA, 145 bp, Homo sapiens
cattagcagcttttaatccactaaaaaaacaagagtcttggagaatgggacctttatcttatctctgtgtctcaaatcttagcacaacgcctggcacttaataaatactgaatagcatttctggatgaatcaacgagtgaatgaa

SEQ ID NO: 406938 - DNA, 633 bp, Homo sapiens
tgttgggcaccaatgatgccaggcactactctaggtgctcaggatacaataattaataaggcagacaatgccctggcttcatggagataaatgtgttgatgaacaggaagtagatagagtggtcagagaaggctggtggagagcacagttgaccagagatctgatggaagtgagaaagcaaactatgggaatatctggaaaaagagcattccaggcagaggaatgagcaagtggcaaagatcctcaaatgcctatacttccatggaagaaggccagtgagtgaggaaaagagaggtagcaaaggggatcagagaggatacagggatccagatctcaaagggacttgtaggtaatggccaccactttggacttcatgttttcggagtgacggaaagtccctacagcctttcccagcccctagctaagcctctattgattacttctccttcttgtgctcttatcacctgtacttttatttaccagttagtctatattccatggatttctattcatctcttgtgtatcaattctatgtcctcaactatgtctcaacggcaagaatcagtcatattctcttctgtattcccagggcctggcacctaacagatgctcaataaatctttccagaaggtg

SEQ ID NO: 406939 - DNA, 370 bp, Homo sapiens
tgttgggcaccaatgatgccaggcactactctaggtgctcaggatacaataattaataaggcagacaatgccctggcttcatggagataaatgtgttgatgaacaggaagtagatagagtggtcagagaaggctggtggagagcacagttgaccagagatctgatggaagtgagaaagcaaactatgggaatatctggaaaaagagcattccaggcagaggaatgagcaagtggcaaagatcctcaaatgcctatacttccatggaagaaggccagtgagtgaggaaaagagaggtagcaaaggggctgggaaaggctgtagggactttccgtcactccgaaaacatgaagtccaaagtgtgcctacata

SEQ ID NO: 406940 - DNA, 1032 bp, Homo sapiens
  misc_feature (80)..(80): n is a, c, g, or t
  misc_feature (105)..(105): n is a, c, g, or t
gggcggtcgctgtagctgagcaggactggggctaggttctatgtccctgtggctatgtgccatggtgtcctctgggtgtntccaagagcaacaagaaacgaatanatctctggtgactttttgaaaaaatagtatctcttgttgcaagaaatggtccatctgtgatttcaagtctctcgcttgagtgaattggatggaagtggtgaatttcagccaaagtggccaaagaaatcctgttcctgtgataatgacgccatcagcctctgcatctctgtcttcccttctgccacatgttgcctgttctccgtgactttgacccttctcaggtgcagccagagagacactagcccactgatggacggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagttttgagaagcgggtaagctgtatgttttgtggttttgtttcataaattcatctacaggaagaccaatattgactgaatgaagctttcatttaaagagctaaaatatgctttgtgtttttatatgtggatactactttaaacctaacgactattcattgtatcatagcttgtgatgtattctgctcatggcttttaaggtaaattgtgccatgatccactgccattctaattgctttaacaagtcattaccacactactgttacatcttaattatgcatacagacaggtagacttgttttacatatgtgaactaactagttgtcaaagcaaatgcagattgtattctgcaagtaaagtctttttctctctgaaatttctagggatgttctttaagtgaaattcatattaaaactgaagattttagttacagaactgagtgcagattaaagtcttttgtgattcaacatagtcagcagtacaccttccgtgcgggatcctca

SEQ ID NO: 406941 - DNA, 829 bp, Homo sapiens
  misc_feature (80)..(80): n is a, c, g, or t
  misc_feature (105)..(105): n is a, c, g, or t
gggcggtcgctgtagctgagcaggactggggctaggttctatgtccctgtggctatgtgccatggtgtcctctgggtgtntccaagagcaacaagaaacgaatanatctctgacccttctcaggtgcagccagagagacactagcccactgatggacggacagacgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagttttgagaagcgggtaagctgtatgttttgtggttttgtttcataaattcatctacaggaagaccaatattgactgaatgaagctttcatttaaagagctaaaatatgctttgtgtttttatatgtggatactactttaaacctaacgactattcattgtatcatagcttgtgatgtattctgctcatggcttttaaggtaaattgtgccatgatccactgccattctaattgctttaacaagtcattaccacactactgttacatcttaattatgcatacagacaggtagacttgttttacatatgtgaactaactagttgtcaaagcaaatgcagattgtattctgcaagtaaagtctttttctctctgaaatttctagggatgttctttaagtgaaattcatattaaaactgaagattttagttacagaactgagtgcagattaaagtcttttgtgattcaacatagtcagcagtacaccttccgtgcgggatcctca

SEQ ID NO: 406942 - DNA, 370 bp, Homo sapiens
gtaagagcttccttgtgtatgaggatgatgtccaggatgttggtctggtgtccctgagacagcactaacaggtccatggctgggtccaggtcattcctggactcattggcaaagagcttactgatgttcttgaaggcatctctggtgaagtggatggcctagtcaagttccaaggcctggctgaagctgaagaaaaactggccacctcctgatgctctttctaaaagcctgtcactgtcatctgcttgcttgtcaactcattggctgtgaggatgagctgagtggcctgtgtccatcttcttggggaagcatttgaagccatcagtcttgctctcccacccctaaaggttgagggtcaccacctggggtt

SEQ ID NO: 406943 - DNA, 851 bp, Homo sapiens
ggtagttgctctgtcctgttgtagcctactttgcattgctgtgtgaaagactgggaaagactgaaaggctctggattgaacatagtggcctgtttcagttaccgtagggcccagagcttacccagaggaaaaataaactcatctacaacactaaaatagtcacagggtcaccaaggcaaagacctagaggggtccatggaggactctatgtgcatagagaaacactggatgtgaggtaataaccagggatttgggtagactggtgaactagggcacatgccatcatggacaaaggaatagccatagttccccatcaactgggactgtgcagggtgagggtgtgcagaacaactccagagctacagacctttgtatttgccatgttaaagtttttgccacagttaaagcagataaatgcaatgtcatgtacattcacttcacctctctcaaactgtatcttggcacccatcactccccaggtaggaactgggagctgagagaagtgatagcctgacgtccaggaaagtggtttttgcagtctggccagggtttctggtcactaacacacacttcatgccttcacagtcttgctggccaacagagtgggcacaggcagatgggggcatttaacacagttgacagagctggtattttagaaggagctagagatccagaaccttgtagaatatggtgtttggcaccttttttttttgatatggagtcttgctctgtcgcccaagctggagtgcagtggcgcgattttggctcacggcaagctccacctcctaaatggctcacgccattctcctgcctcagcctcccgagtagctggaactacagttgcccgccac

SEQ ID NO: 406944 - DNA, 1265 bp, Homo sapiens
tcggaaacagccagggctttcgcaacagtgaagctgcagatcccatttatttccgtcttagtagcattgtctctgttcaaatgaggtcactgaacttttaaaaacttcactgagggtcgtgcttctttgcatattgatcatgtgaatgtttagtggacttgccttagttgctggtacctaagatagagattaagggccctcaaggggtattcagacctcaaattcagccaaacacaggcgcagcttttcctgggtctgagtgagctgaggaaagcacttttgaatgtgcaaggacaataagattaataaccactaccatctctgcagtacgtactgtgtaccagacgctgtgccaagtgaccaacagacattaccgaattcatctttgccgcaacccaacaagggaactgagggtcagagaaggggtccagccaggggccgccaaggttcggactcagcctgggaccactggctccaaagctgggggtccttactcctgttgagctgcaggcccctccaacacaggcagtgggtgggcccccaaatagctcatcttcaaggatatggcctccggaaagcccagggaaagtgtggatcgattttcctgggtcaaggaagaatcaaacctacacttctttacctatttgatgacacaaacccctttgagaaccaggggttggatggagcctctccctgcaaaaaagaccccatctgccaaactgcaggggtccagagaccccctgccccctgaaacccttccatggacctcaggtttagaatctctccattaagccatgagcatgattatttgaaagttaaaatgaggccagaagggataatagtaacagtcataataatacgaataacaggatacattttactgatcacctgttgtcaggcatttatgccaggggtcggcaaacattttctgtaaaaggctaaatactaaacattttagactttgcaggctatacagtctcagatccattgaccagaaccacaggccagccactgggaccctggatgactccaacaagccctggagccatctacgcaactccatgaggagtcgggggatgggggccaccaagctccccttgttattagccacagacaatatgtaaacaaatggtcacgcttgtgttcccataaaacttcacggacaccaaaacctgaagtttatataatgttcatgtgtcacgaaatgctacaaaatgctattcttttgattttttccccccaaaattaaaaagtgtaaaaaccgg

SEQ ID NO: 406945 - DNA, 1788 bp, Homo sapiens
  misc_feature (1)..(1): n is a, c, g, or t
  misc_feature (6)..(6): n is a, c, g, or t
ngacgngggcggggatcagagagaagcgagggcctggttctgaggggtcggcttgagatcggctgagggaagcgggctcagggtctgtgaggaggcaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgct

SEQ ID NO: 406946 - DNA, 2039 bp, Homo sapiens
  misc_feature (1)..(1): n is a, c, g, or t
  misc_feature (6)..(6): n is a, c, g, or t
ngacgngggcggggatcagagagaagcgagggcctggttctgaggggtcggcttgagatcggctgagggaagcgggctcagggtctgtgaggaggcaaggagctccaggaaccaggctgtgaggtcttggtctgaggcagtatcttcaatcacagagcataagaggcccaggcagtagtagcagtcaagctgaggtggtgtttcccctgtatgtataccagaggcccctctggcatcagaacagcaggaaccccacagttcctggccctaccagcccttttgtcagtcctggagccttggcctttgccaggaggctgcaccctgagatgccctctcaatttctccttcaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgct

SEQ ID NO: 406947 - DNA, 2067 bp, Homo sapiens
  misc_feature (1)..(1): n is a, c, g, or t
  misc_feature (6)..(6): n is a, c, g, or t
ngacgngggcggggatcagagagaagcgagggcctggttctgaggggtcggcttgagatcggctgagggaagcgggctcagggtctgtgaggaggcaagcaggcaaaaaacagatgggggcccaacagaaatctgcccggcctcttttgtcacccctgagagcatgagcaggactatcagctgaggcccctgtgttataccagactcattggtctcagggagaagaaggccttggtctgagggcactgcattcaggtcagcagagcgggggtccaaggccctgccaggagtcagggactcagaggacaccactcaccaaacacacaggaccgaaccccaccctgcaccttctgtcagccatgggaagtgcagggaaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgct

SEQ ID NO: 406948 - DNA, 385 bp, Homo sapiens
attcagtattgccaccatatctaagcttatgattagtggtctcttcttgttgaagaagctgtgggtcagtttgagtgacaaactcaaatggcaaatcacatctggtgggagttgtgttgcacattagtcctgtgaagtaaggtcacatatcagtttgcaggagtttggaaatctaaaaaaacgagtcctttaccatgggtagtttgagatgcactgctctggagaatgacgttagagagctctctaggttggcttaaaatgtgggattttgttggatgctcttccattaactggtcctgctactaagtgctgtattagcactggtgcacattgaactacagaagcattgttgctcttcactagtcaatgcaaacttgtaagtagt

SEQ ID NO: 406949 - DNA, 550 bp, Homo sapiens
tacctactgtgtcacagcactgcatgtggctcaacagaccagggctttaaatgcctttgacatctactctctgaagaaatacatttatatcacaacccagtgtacaatacatgaagccatcgtgcctggcctagtcttctttttactaaaaagtgagattattaagtgtaaaaagacctactagtaccaaatgagatttttttctaaactcgattatgagaattgaaagaaaagtggaaaaataatcacttcttctgtgggtgatttgtgttatttgctgcccaatctgggttccacctaaaaccgtctcaggtacaccactgcgcagcctcccagaaccacccacctccttcctgacggccaggagacaaaggacccttgggcgcgatcagccgcaccttcaggctgagtggccaggagtcctcccgtggcccagcccacctctctctttcaggaattcaagtcagcgtttttgttggtccggatctgaagccacttcttccaggcagctgcccctgatctctcaacttcatagcattttggctcttta

SEQ ID NO: 406950 - DNA, 550 bp, Homo sapiens
tataccaggggtccccaacccccaggccatggacaagtactggtccatggcctgttaggaactgggccacacagcaggaggtgagcagaaggtgagtgagcattaccacctgagccgcctcctgtcatatcagcggcagcattcgattctcataaaagtgcaaagcctattgtgaactgcataggcgagggatctaggttgcccgctccttatgagaatctaatgtctggtgatctgaggtggaacagtttcatcccaaaaccatccctccacacctgtctgtggaaaaattgtcttctatgaaattggtccatgccaaaaaggttgccaaaaaggttggggaccactggtacataggacttgctctataaatgtttgttgaatgatttctgcagtgctaatgagctccatgcacaaggtttaggaaattgggctgaatctgtacaaatcccagatcatactttgaaaaactgtgattagttttcttgatactaaattcctcatatgagcttgtcctgttagcactttctttcacaaagtgagatgtaga

SEQ ID NO: 406951 - DNA, 453 bp, Homo sapiens
gttcctctcttttggacataatctggggtttttagtattcctcctaaattgttgtacccagaaagagcaaagagagtggtatctcttcattgtggtgaagaacagagcttttcacccgtttcattctgccgtatgtctttgaattgtagtatattgatttctgctttgaggtctcttttaatagcatcccaattttaattattgtttggttgctattttgttattctgttttcttataaggatgtgtgtcattaatattcattgagtactcactgtgcatattactgtattctgccaaataggaaaaacttagaatagaaaaatttgttcttctctcaagtgtcttatagaatgatcaaggataaggtgcatatttactgatgctttaaaaataatacttaaactgcagtacttaaagtagtgctcatggactctaaatccagagaaaatgga

SEQ ID NO: 406952 - DNA, 538 bp, Homo sapiens
  misc_feature (531)..(531): n is a, c, g, or t
ggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggaggtctgacattcaaggatatttatctaaaaattcttcttttgagtgccagtaaagcatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaagtgaagaagaataaaagagaaagaaaggaagancggcaga

SEQ ID NO: 406953 - DNA, 1538 bp, Homo sapiens
  misc_feature (451)..(451): n is a, c, g, or t
ggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtaaattgcttaatcatttggccaaataattagacaactataagattttggatatattattttaagtactctttaggcatgttatgatacttgaacttcactgtttgctatngaatcatcaccttaaatatttaaaggtgttaattaatgggtataaaatttaaatcagtattactggcagacgttattttaggaaaacaccagataactatatcatgtcaatataatagagtaagatacactttttagcagtgaacttttaaaaaattcttttacttttaacttcttgtcaaagtatcctgaaaaatgatataaaaatgttattgaaaatattatttatgaagctttttcttaataattaaaaaaaatcttttctaatgtggggtgctatgtaaattagcaaagcagtctaactagaatggattttactgaaccagtctaacatttactttccaagaaacattcaggacatattcctttaattctaattttaaaggaagagcatattgcaataataaaaatatttttaaaattatgttcaggttatttattgacaggtactacttacaccaaagcacttgtgctctaggctagaagcattgtattaaagccatgaatactatacctttgactagtcgagattgtatttatattttcctgttactactgtataaagcttaaacctacttaaacaactacaagctttaaggttgaccatatttcaggagaaggggtgtctactttttgaggcacaaaggttcctgctgaatataagtaaaactagttagtagacatgtgaaacagtcatccttctgcataaattgaaggatccggattccttaatgatggactgaatgatgcttactttccttctttctgcttccagtgtaccactatggtttatagtaaagaaaaattaagaaagtgaacagttgcaactattttgcttatgtgatagatgttttgaaaaatgtagttggaaataggaataatttttatatggttactaggattcagaagtaaatctatttagtgatctgtaaataattgaagtaatgtaacacttaatgttttaatatgtcagttattgcccttttatattgtgaatgtaatgtgcataagctatatccgtagatgttattgttttatctcatgtgtaattgtgggcctttataaaattgtgttgtaagatatcaagc

SEQ ID NO: 406954 - DNA, 494 bp, Homo sapiens
gtgtatatatgtgtgtgtgtgtgtgtgtgtgtatgattatttagaaatacagttaaggggaaaatatgacctttaagcatttcagttatggaggataaagtaatggcttcagtaaattatatgctcacattggtatggaatggacagtcaacaaatacttaatgaatttgttataatttacaatgaaaagtttcaaaatggcatttatttctcatgatatggcaagtaaaaatttcacttgccagatcatgtaataatgaatgtgctgattttgaaagccatgttctatttgctgatggtgagaatccttttgaaattcaagaccattctcaggatcagcaaatagaaggagatgaggaggatgaagagaagattgatgaacctattgaagaagaggaggatgaagatgaagaagaagaagcagaggaagtgggggaagtagaggaagtggaagaagtagaggaagtgagagaaggaggaatagagggcgaggg

SEQ ID NO: 406955 - DNA, 2145 bp, Homo sapiens
ggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagataagcctcagcaaatcacccacaaaaatgatcctaaaaatgaagaggaagaaaagcggcgaattgaggctcggcgagagaaaccaaaggcgcaaggaagagaaaaaaaccagtgagaaatacggagatggatacagaatggcatttaccatgttcatttttcgtacactttccgaacatttgaagaaaaagatattgaacttgcatctggaaagttcttcacatcaggaaacattagatcatatacagaaacaaactaaatttgataaagtagttcatggagtttttggcatgagtgtattgggggaattagatgcaaggaacaacattttatttcgtaagggcaaagacaaattattccaccagaaagtagttaaacataaattgacaacgatgggttggacgtgttctgtggatgtcacttgtggaggttcagcagttatgaggttggcagtgttaatcctgttattattagtcagggctaaactctggacttcaaggaaccggttagaaataagaagggttgggtatttaatacagggcaaattgcgggaactgg

SEQ ID NO: 406956 - DNA, 1594 bp, Homo sapiens
  misc_feature (451)..(451): n is a, c, g, or t
ggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtaaattgcttaatcatttggccaaataattagacaactataagattttggatatattattttaagtactctttaggcatgttatgatacttgaacttcactgtttgctatngaatcatcaccttaaatatttaaaggtgttaattaatgggtataaaatttaaatcagtattactggcagacgttattttaggaaaacaccagataactatatcatgtcaatataatagagtaagatacactttttagcagtgaacttttaaaaaattcttttacttttaacttcttgtcaaagtatcctgaaaaatgatataaaaatgttattgaaaatattatttatgaagctttttcttaataattaaaaaaaatcttttctaatgtggggtgctatgtaaattagcaaagcagtctaactagaatggattttactgaaccagtctaacatttactttccaagaaacattcaggacatattcctttaattctaattttaaaggaagagcatattgcaataataaaaatatttttaaaattatgttcaggttatttattgacaggtactacttacaccaaagcacttgtgctctaggctagaagcattgtattaaagccatgaatactatacctttgactagtcgagattgtatttatattttcctgttactactgtataaagcttaaacctacttaaacaactacaagctttaaggttgaccatatttcaggagaaggggtgtctactttttgaggcacaaaggttcctgctgaatataagtaaaactagttagtagacatgtgaaacagtcatccttctgcataaattgaaggatccggattccttaatgatggactgaatgatgcttactttccttctttctgcttccagtgtaccactatggtttatagtaaagaaaaattaagaaagtgaacagttgcaactattttgcttatgtgatagatgttttgaaaaatgtagttggaaataggaataatttttatatggttactaggattcagaagtaaatctatttagtgatctgtaaataattgaagtaatgtaacacttaatgttttaatatgtcagttattgcccttttatattgtgaatgtaatgtgcataagctatatccgtagatgttattgttttatctcatgtgtaattgtgggcctttataaaattgtgttgtaagatatcaagcaacttttgtaatccatgctttgggtttgtgagaaggaagatgatttatttcttctg

SEQ ID NO: 406957 - DNA, 739 bp, Homo sapiens
gcctcttggtgtagtagatttggataatgacaagagaagaggaagggacacaaagagtcgtttggttgcatgactcttcatctgtaaacttttgtttcttgggcttctgggtcagaaaatgtttctctaggtaagaatgtgaatggaacgtcagatgcaattctttatctgaagtgtgtcttggaagttgatgcatggttatgctttaactctcctatttcatactaatgttccatctcgccttctcattccctttttcaacagggagaatactaaatgatttctggatcttttttacttcaaactacaaatatggtcttctttgtgtatcttagttttagtaaaataaagatttcttttagggtcttttcatgggaaaacatcaattaggaactctgaagaggagttgtcagagagttgtacaagtggtaacatttggacaggcacatatgttgtctataatctcaagtaattttgaaatgtaaaagtaaaaacatagttagcaaatattcattatttgttctactggaaataaaaatactaattcaatggatttgagtttatgtaataatttacagagtttttcaatgtgttttttcagaatggacatgtaaaatttagttacattccagggaattttcaggtgaaaattagtagatagttaacatgaaaattttatatgaattcatattttttcttggacaatatgctaatatttattgatttcacaaatttacag

SEQ ID NO: 406958 - DNA, 175 bp, Homo sapiens
tttgttttaactattctcagttttgcagataattgggttaatgtcattttaaaaattgtgcttgttttttactggatcggcatataattttgaattattgctaatatcacactaattcctttttgttaaatgtgtcttcatagattacacacactccgcctgcaggaatacttat

SEQ ID NO: 406959 - DNA, 1728 bp, Homo sapiens
ggctcccgggctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtttatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatgaagaagaagaagcagaggaagtgggggaagtagaggaagtggaagaagtagaggaagtgagagaaggaggaatagagggcgaggg

SEQ ID NO: 406960 - DNA, 501 bp, Homo sapiens
ggcacgagggtggtatacgcctgtggtttcagcctcccaagtagttgagactacaggcatgcaccaccacgcccagctaatttttgtatttttagtagagatgggggtctcactatgttgaccagactggtctcgaactcctgacctcaagtcatctgcccacctcggcctcccaaagtgctggggttacaggcatgagctaccatgcccagacccacacctcattttccattaatggaaccaggactccttggttccaacctggggccgggaaaatatattatgaacttagaatactgtattttatagaacatccggaaagtaaggacctattcaaagcatgatgggggaaatgtcacaggcaaaagtagtgatgacttgagcatcaaaataaataactttagaaacgttataacccaggtaatcaaataggttgcagtgagccgagattgtgccactgtactccagcgtgggtgacagagtgagactctgtctcaaatt

SEQ ID NO: 406961 - DNA, 674 bp, Homo sapiens
aattaactatctgacctctaccccacccccccgcaacttcatggaaaaatgactttctcagcgttcgttcctgaaattattgccaaacccagtgttttattcttcaccctgtttgcctcctctgagcattgaatgttacctacctctctccttgaatcctggctccagctatcctggttacgttctgaatgtgcctttgcacggtattttgtgactcttcttttctgtactgataccttttctttctggatactttcttctatggcagtctcatacattctcaaggatttaacatttactccacttaaaagagttccaagatcatctactgaatcattaagcaaatatttgttaaatccaggctctatgcccttccaagttgaggcaacagcagtgggaaggaggcaggaaacaaactgcatctgttggaggaactgcaagaagctagtgtgattgggagggctgtggggagcagagggaagtggctggagtctgatctctaagtgtctagccccttcctttctcccaaggccccagtccacactatctggcatcttcacttcatggctaatttaacactgtcagtgctgtcaattgctcttcccccagaactgtatttttcacatctgaagttctgttaaaggacaacgtttcacaaataaaaatgataacta

SEQ ID NO: 406962 - DNA, 2455 bp, Homo sapiens
actccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggcttcaagagagagcggagcaagtgtcccgggcccttcagccagccctggatagctacttccatcccccggggactcccgcgccgggacgtggggtgggaccaggggcgggacctggggcgggggacgggacttaaataaaggcagacgctgtttttctacccatgtggccc

SEQ ID NO: 406963 - DNA, 2425 bp, Homo sapiens
actccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggcttcaagagagagcggagcaagtgtcccgggcccttcagccagccctggatagctacttccatcccccggggactcccgcgccgggacgtggggtgggaccaggggcgggacctggggcgggggacgggacttaaataaaggcagacgctgtttttctacccatgtggccc

SEQ ID NO: 406964 - DNA, 1946 bp, Homo sapiens
actccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaattggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggcttcaagagagagcggagcaagtgtcccgggcccttcagccagccctggatagctacttccatcccccggggactcccgcgccgggacgtggggtgggaccaggggcgggacctggggcgggggacgggacttaaataaaggcagacgctgtttttctacccatgtggccc

SEQ ID NO: 406965 - DNA, 2514 bp, Homo sapiens
actccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctggggtgccaccaaattctgggcttggaacagcttcagctcccacccgctcctccacacacagacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggcttcaagagagagcggagcaagtgtcccgggcccttcagccagccctggatagctacttccatcccccggggactcccgcgccgggacgtggggtgggaccaggggcgggacctggggcgggggacgggacttaaataaaggcagacgctgtttttctacccatgtggccc

SEQ ID NO: 406966 - DNA, 302 bp, Homo sapiens
catgacttgtgaataggcggtgagtgtgtcctttaatcagtcacacagaacttgctttataaagctgttattgtcatgaacagatattgcagtcttgtcaggcccagtgattattaaagtgttccttcttcaaaagccaggccgaaagtcctgctgtgcttcatttcacaattgaagtccattagtaaataaaatcccaagccgcacgatttgctgttcctcaagttataggcttacatatatttcattaataatcttgggcccttttgtagacataagtaggtatatttttggtatatata

SEQ ID NO: 406967 - DNA, 260 bp, Homo sapiens
gagattattttgaagaaaacagaaaaattaagattataattgtgaacattctatactatatatagtatggaaatgttggttttcttttttcgcttgctggagtggagaggagagggcagagactaaagatagatctcttgatttgtagttttcctaaaatcacatgtagaagtttcattaaagaatagtgcttggaatgtagtaggcaaaatattatggatggatggatggatggagtgggtagatggatagatggatga

SEQ ID NO: 406968 - DNA, 387 bp, Homo sapiens
aaagaaaaaaaaaaaaagactatgaaaagggtcacagaaattaatttcgcattgatgactaaaatgagagtggtagagggggagggaacagacactgaagactgaggagtgaaggtaagtttaaaaaacactgaaaacaaaaagtatgggaaatacgggtgataaagggaagaactaaaaactgggcagcagctatagggagaggcaacgttgagggaaagttttttagaaatgaaaatgacaagtatatttacagaaagacagaaaggagccaatgaagaaaaaagtctgaaaatacataaaaaagaaacaattttttctggaacaaagcccacaaaattgctagaagatatgggattgaaaaagcacaggtgggccgggcgcggt

SEQ ID NO: 406969 - DNA, 442 bp, Homo sapiens
taggctttaggccctatatttgtaaaggatagttgctacctgtatttagggattgggcatcgactgcaagaaccctggggaaaaaaattggaacctaagagtgtggcagggggcatcctagaaacctcttcaaaatgggggtcacgtgtcctcagaatggctctcaggaaggctccttggcattcatatttgtgaaaaggttgcaggaccaccatataagcgggcaaagatggctttattgcggaagcaggaagattactattctgtagctgagaaaatcagagagtagagggttttgctcctgctgcatttgaatggaattggcagtgagctggaatatagcctgcctgtgggtggagttagtgcacagcatcagtgggcaggcaagggaaaataaaatatacctactttgactttgcagccagaaagagggagaataagc

SEQ ID NO: 406970 - DNA, 447 bp, Homo sapiens
aaaaaaaaaaaaaaagaaaaaaaaacccgtctttactaaaaatacaaaaagttagctgggcgtggtggcacgcccctgtagtccctgctactcaggaggctgaggcaggagaatcgcttgaacccttggagtggaagttgcagtgagctgaggtggcaccactgcactccagtgtgggcgacagagcgagactacatctcaaaaaaaaaaaaaaaaaaaaaaggcctgggccccaccccagacctccagaatcagaatctctgggagcctggtgtggaatttgcatatttagaaacacaccaagcaagtctgataagcactaaaattcaagaactcctgggttgaagcagctgtagttaagtatacatacccctgagggtacttgaagattttccaaggcatatgtaggcatagatagttttaaagtaatcaatttccagatcattc

SEQ ID NO: 406971 - DNA, 635 bp, Homo sapiens
gggagggagataggcctggggagaagttatctcccttcagtcagttatccagatattgccaaatatctcaacacagtatctggcagaacaaatacatagaaaaatattttatatacattatgccccatcacaatggatagcaaaggattaactgtgcccatgatcatgaaagagctaccacttccacactttgggcagagagggagatgaagtcctaggctaattaaatgatggataggctcctcaagtgtatgtttttctaagggttatcatcaatatgtgcacactcatggaaatgccacctttcaagccactttaaaaacacaggtaataagaaaacaaactgattagtaaaaaacatttgatttcatagactctgttgcatgcaacccaactatttcataaggtaaaaacagtgctatatttttgataatgtcccattatcttgctttaatactatcaacaactgcttgtacaaaagaaacagccatgattgaattctgattttttttttcttgctttctgccagagtttgccaagaactgctttagcccccagcccacagcactgtggggctgcaaggaatgctctatagggtccaggattttaagagtcaaggcaagaatgagagtaag

SEQ ID NO: 406972 - DNA, 546 bp, Homo sapiens
gcgtagctccctgggcgcttcgaagatccagcggcttgctgtgagtccgggaggcaaaattgtacccatttcaaagatgtgatgactaaagtctcgagagggccaaggctcgcccaaggttgctctgtggtgacagctttacctccttgctatgtattctcagatattgcaaacggacgagagaaaagtggagaatgaatcctggagaaaacaaggtcgttcgacgatttcgacacgtcgcatccctgagagtctctcgtgtcctgatcaactcgagaactggaggcggtgacattttagatgctgcagtgaaagccacagagccacggaaggccgagactccaccatgtttgtgatcttcacattcagcaaactcactcgcactctgcctcatcttatctctagaatgtattttaccacactgtgtcccttctttagtgggaatgtctttggccaaaaataatgaatagttctgacctgacttgctaatacccagtgataaaaggatggaatttgttgggaataaaagaaaactaagcttaaaaa

SEQ ID NO: 406973 - DNA, 599 bp, Homo sapiens
gcgtagctccctgggcgcttcgaagatccagcggcttgctgtgagtccgggaggcaaaattgtacccatttcaaagatgtgatgactaaagtctcgagagggccaaggctcgcccaaggttgctctgtggtgacagctttacctccttgctatgtattctcagatattgcaaacggacgagagaaaagtggagaatgaatcctggagaaaacaaggtcgttcgacgatttcgacacgtcgcatccctgagagtctctcgtgtcctgatcaactcgagaactggaggcggtgacattttagatgctgcagtgaaagccacagagccacggaaggccgagactccaccatgtttgtgatcttcacattcagcaaactcactcgcactctgcctcatcttatctctagaatgtattttaccacactgtgtcccttctttagtgggaatgtctttggccaaaaataatgaatagttctgacctgacttgctaatacccagtgataaaaggatggaatttgttgggaataaaagaaaactaagcttaaaaacgagggccctgatgctccgttccgagcttggtcatctaatttccagccaaaaa

SEQ ID NO: 406974 - DNA, 809 bp, Homo sapiens
gcgtagctccctgggcgcttcgaagatccagcggcttgctgtgagtccgggaggcaaaattgtacccatttcaaagatgtgatgactaaagtctcgagagggccaaggctcgcccaaggttgctctgtggtgacagctttacctccttgctatgtattctcagatattgcaaacggacgagagaaaagtggagaatgaatcctggagaaaacaaggtcgttcgacgatttcgacacgtcgcatccctgagagtctctcgtgtcctgatcaactcgagaactggaggcggtgacattttagatgctgcagtgaaagccacagagccacggaaggccgagactccaccatgtttgtgatcttcacattcagcaaactcactcgcactctgcctcatcttatctctagaatgtattttaccacactgtgtcccttctttagtgggaatgtctttggccaaaaataatgaatagttctgacctgacttgctaatacccagtgataaaaggatggaatttgttgggaataaaagaaaactaagcttaaaaaaaaaaaaaaaaaaaaaaaaacttgtggggggtatgggcctgaaaaagcttttttaaaaccatctgttgtgcgccgcgggccccatgtgtatagtaccagggtgccaagcggtgtcccaagagaacacccgcggcacagacaaagggcgggaatcccacccaatataaaagcgcgcggggaacacaccgccgcgtttgaaacaactcgaagggatctcaggagcaaacgggagacttaaacagggctccacggagcccatcaaa

SEQ ID NO: 406975 - DNA, 264 bp, Homo sapiens
ttctgatcatttccacaaattcaagatattagtgatggaaaatcaactggccaaaatttcatcctgaaatattcaagcttcatttaaacgtttaaagaataagatggaaatgttacattcttttttgaaaaaggcaagaaatagaaaaatggatagattaacagactgatcagttgatttactgatcagttaatagataaacacattacacccttaagtaggttggttctttttcttccatacattgtctattttcatttttta

SEQ ID NO: 406976 - DNA, 787 bp, Homo sapiens
aaaactatattttggaagtaaattattgaaacataactatgttatatttgaatattaacaaaaggacagtggttcaataaatacagaaatgtttataacttagtgcctttatctgtgaagcttaaggataacttcctcatggtgttatgaggattaaataagattaagtaattaaagtgctaagcttagtgccaggcacataagctctttatatacgttaattgtattcctctgtataaatatataaaaggggtatgaacttgtcaacatatgcattacaaataatttcttaatcttgttagatgtttcttcatataaacattttattgtttgctgtcaactaagacacataagttagtgtatattaactttagattttatcagggaacccactaaaatactttcttggctatggattgtaccattccaaattgctactggtaattattagtaataattagagggaataaaaattttaatttattgatgttttagttttgtttgtttctttaattctgaatttgtcttaaagtttgtgatgattgttaagtccatcatgttagagatccttttaaaagtatcagttaccatcagcctgggcaacatggtgaaaccccgtccctaataaaaatacaaaaatagccaggtatggcggcacacttgtgtaatcccagctactcaggagcctgagtcaggagaatcgcttgagcccaggagctggaggttgcagtgagccgagatcgtgccactgcactccagcctgggcaacagagcgagactctctcaa

SEQ ID NO: 406977 - DNA, 467 bp, Homo sapiens
aaatcacaaaggtgtgtatttttctagagattccagacaagataattttgagggctcttatactatgattataaaaacctaataactatgttttaatgtagtgcattgtgtttttaccacttaagatggcagtgatttcatcagacagctttcttttggggagacttccaaaccaatctttgggggagaatctaatctcttttttgccaagctggtgaggttttcttcccccacattgaatgtttatatggaaagatatgaaccataaacatttttatataaaaacttattctttttgctttttattggctgcattgtaaggagtcatttggcctagagggaaaggagggtaacattccctatggcaaactacaacgaatcttccttctcctttcccaactccagcagtaatgatggaaaatcagtgcagcatcctagtgcattcgcagtgtggtttgacaaagacc

SEQ ID NO: 406978 - DNA, 339 bp, Homo sapiens
gatatattgcttgtcaaaatagctaattatagtctgtaacaagtcactagagcaaaatttaatactagtggaaaagtctgctaaaaagtttatgttttaatagtgtgtttgatggttatattattaaaagcaaagcattttaatgctttttcttcctattaactatcggcaacattttagggatatatcattaatcattgcttagtcctctcaatttctaaatgaaagatttttaaaattcagtatttaaaaactacttagtttgactcaaggtatttattctctaagtccatatggattttgtgactgcactgccctcccccaaaacagcacaacaac

SEQ ID NO: 406979 - DNA, 547 bp, Homo sapiens
atattcctacaggtaggaattttctggtgaccccctacctatggctgctctaactcatattaggagagtgaattcatttgtcctgaaagatgacttttgtattcttcttgccatgttctcccctaccccctgcctttttaaaaacaccagttcttgaaattgtgttattgtttttctttttatttctaggatgtacctacctagtatgtgttttgcaaacgctattgatgacttacacaattataaccagtgtttatcttgtcaaaaagttttacatattcagtgattctcaaattttgctcctgtggagcatagactcattgaatcgacctgaaatttccatactaaatttaaataatgatagacttttcccagtttatggaagaaactatgcatagagtttttctgttccaacattgcccctttctgggccaggcatggtggctcatgcttgtaaacccagcactttgggaggccaagatggaaggatcacttgaggccaggagtttgagactagcttgagcaacatagtgagactgtctctaca

SEQ ID NO: 406980 - DNA, 397 bp, Homo sapiens
ctactcaggaggctgaggcaggagaatcgcttgaaactgggaggcggagcttgcagtgatccgagatcacgccactgcaccccagcctgggagacagagcaagactctgtctcaaaaaaaaaaaaaagtatgcaggccaggtgcagtggctcacacctgtaatcccaacactttgggaggccaaggggggcagatcacctgagcccaggagttcgagaccagcctggccatcatggccatccctgtctttactaaaaatacaaaaattagccaggcatggtggtgggtgcctgtaatcccagctactcaggaggctgaggcagaattgtttgaacccgggaggcggaggttgcagtgaaccaagatcgtgccatcgcactccagccagagagcaaga

SEQ ID NO: 406981 - DNA, 457 bp, Homo sapiens
tgacaatacgatccaccacttcctgggtacctccctgcccccaagccagatggcatcagaccacacattggggccaagcacttcttggtgggactatgttgggagggaaacaaggctggtaccctccagccagggacaggcaccagcagcacttgcagagcctatggtgtgattagcactaggaggtggctctcactggggagtgggggcaggggagaccccggcggggatgaggcaggtcttgtggagtgaacttcacagtggagggggggcagtatggcagagtagaagacagcatggtgtcaaaatctattcaaatccttccttgtgctgtgtgatcctgagtgagtgtcctaaactctctgagcctcagtttcctccagcatagaatagagaacctgccctgtgaagatgaaataaaacacagcccacagccaaagccagcaacccctgggat

SEQ ID NO: 406982 - DNA, 460 bp, Homo sapiens
gcctaattcttcttgagtgtttagatttaatttttcaatgcagttttttcatgtatttgatgtttatactttcctgttttatagaaaaatatataattgaggataaaactgtgttaatctagccttttagtaaaccacttctttggatttctagttatactgttagaacataaccagtgtggtagttttcttaatattatctttcaagaccctaggaaaaagtaagcagccaaagtcaaacctcagaatgatggcaaattttattctaaaaaatatgagaagatcttattaaaccaaggggtaaattgagttggtggttgtagtaaatactattatgaaaaatagaaggctggacatggtggctcacacctgtaatcccagcactttgggaggctgaggtgggaggatcgcttgagctcaggagtttaagactagcctgggcaacataaggagaccctgt

SEQ ID NO: 406983 - DNA, 488 bp, Homo sapiens
agtccttagcattgatcagaattaatctttggccaggtgcagtggctcacgcctataatcccagcactttgggaggctaaggtgggaggatcatttgagcccaatttgagactagcccaggcaacatagtgagatctcatttctactggaaatgaaaaaattagccaggcatggtggcatctgcctataatcctggctactcaggaggctgaagtgggaggattgtttgagtttgggaggtcgaggctgcagtgagctaggatggcaccactgcactccagcctgggcaacagagtgagaccctgtctcaaaaaaaaaaaagaattctcaatcttctccccgaccacagccttcctcaagtaagctaaaaacaaacatcctctacattgtttgagtcaaatattggctttatccttgacacctcactttctttcctatcccatagtcaattggtctagaaataaaaataaaagtttccccagaattaa

SEQ ID NO: 406984 - DNA, 115 bp, Homo sapiens
taacagcagtttctttggtgattaacctgagctattaataattgctctttttacatcattgatattaaaatcaaactgtgaatgattactatatgagtgtctctataaagccaac

SEQ ID NO: 406985 - DNA, 209 bp, Homo sapiens
aagggcatccgaattggtaaaaaggaagtcaaactgtgactgtttgccagtgatatgactgtttacctagaaaaccctaaatactccttcagaaaactcctagaactgataaagaattcagcaaaattttgggatacaaaattaatgtacacaaatcagtaactcttctacacaccaacagcaacaaagctgagaaacaaatcaagaac

SEQ ID NO: 406986 - DNA, 350 bp, Homo sapiens
tggagacagtgtcttgccctgtcaccaaggctggagtacaatggtgcaaccacagcccactgcaacctcaacctcccgggctcaagcgattctcccacctcagcctcccaagtagctaggactacaggtatatgccatgaccccagctaatttttttttttttgtagagatggggtctcactctacaggttggtcttgaactcctgggctcaagctacatatgctttaagtaactcatgtccacctgcctcagcctcccaaagtgctgagattataggcatgagccactatgcccagccttggctttttcttagatggaaagcttagctcccaaagaagggagggactaa

SEQ ID NO: 406987 - DNA, 2237 bp, Homo sapiens
gggaaggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattgggtctgggtgcctggtatctgaaccccttcttgtctccagagaaccccctattttatgagacttcatgggggggcaataactacctccacttaagagtacctgaaaatgctagacactgactttcccagcctccccttagctagggccaggcatggggaccagggataaacctgtgccacattttgactcagggaagggatcgggagcgctcttttgtgtggtaactgtgataacagtacccgcaaaattgagttcctggtgtagaagtgacaaggatgcaaactgtagcagttggtgctcagtggcagcaacgccatcagaccag

SEQ ID NO: 406988 - DNA, 2402 bp, Homo sapiens
gggaaggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaataataaataaataaatacgaaaagtggtttgtttttttacaaatgtgtggttcatactcctgggtggccttattagcttttttggttgggagacaagggaaggaactttcttggatcagtgtgtgctggtgattttattgccttttcctcttaattcaatcccactctttcccttcctcaagtcttgttcacccagcctcctgccccaggaatcacggggaagaagtctgggagaccacagaaaaaacaccaatgacactgagctattagagatcaaaactgggtcaggaagagttcatgttaagctttcacatgtgctaagaacgctgaaagatacacactgatttccatcttaatagtgccggataattgacaaatttgggacaagatgagggagaggtcaaaatccccctaacttcccaaagcaaaaaaacaggagtataatgatcagaaacgtaatagtagtgtcagaagcacacaatcagctgtggacggtgaaacatataatggttctatctgttctgagattgtaaaagcacaattattttcatcaggataaaaaataaaaatgaaaaactatgctgttgaatggaaatgcta

SEQ ID NO: 406989 - DNA, 2490 bp, Homo sapiens
  misc_feature (348)..(348): n is a, c, g, or t
atgggttcagactttatgccctgaaaagatccttccagccctggccatcttggacttctggagctaccctggctcacaggggtcttgttgccctgggtgtccccagttcttgaaaagaatcagcctgggaggggccacaccctgaccatccccctttatcccttctgagatgtttgttaggaagtctgggtccaggggatatcatttcttgttccatccatgcaggggttgcttacctcgggtaggaaaccctcaggcggtggcaggtgcacaggtaggggaggatggagagggcagtggtgcctgaagccctggatgggcggagctgaccccccaacaccaactctntcatgcctgctcctccctgtccccccagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattgggtctgggtgcctggtatctgaaccccttcttgtctccagagaaccccctattttatgagacttcatgggggggcaataactacctccacttaagagtacctgaaaatgctagacactgactttcccagcctccccttagctagggccaggcatggggaccagggataaacctgtgccacattttgactcagggaagggatcgggagcgctcttttgtgtggtaactgtgataacagtacccgcaaaattgagttcctggtgtagaagtgacaaggatgcaaactgtagcagttggtgctcagtggcagcaacgccatcagaccag

SEQ ID NO: 406990 - DNA, 799 bp, Homo sapiens
acgctgaaacacatccatatgcacaccacacacactgagatacagtgacacacacagtcacagatgcacagacatatgctgatgtaaatgtacaaatgtggtcacactgacacatacatgcaatcatctacgcagactcatagaaaccgacacaaatacctgaaatacacacctgggcgacagagtgtgactgtcttattaataaataaataaatacgaaaagtggtttgtttttttacaaatgtgtggttcatactcctgggtggccttattagcttttttggttgggagacaagggaaggaactttcttggatcagtgtgtgctggtgattttattgccttttcctcttaattcaatcccactctttcccttcctcaagtcttgttcacccagcctcctgccccaggaatcacggggaagaagtctgggagaccacagaaaaaacaccaatgacactgagctattagagatcaaaactgggtcaggaagagttcatgttaagctttcacatgtgctaagaacgctgaaagatacacactgatttccatcttaatagtgccggataattgacaaatttgggacaagatgagggagaggtcaaaatccccctaacttcccaaagcaaaaaaacaggagtataatgatcagaaacgtaatagtagtgtcagaagcacacaatcagctgtggacggtgaaacatataatggttctatctgttctgagattgtaaaagcacaattattttcatcaggataaaaaataaaaatgaaaaactatgctgttgaatggaaatgcta

SEQ ID NO: 406991 - DNA, 801 bp, Homo sapiens
gggaaggttgcttgacaagtcaggattgtgcctccagtcagaaggaccatgaagagagagaagagggcagagccgtgcatggggctgctccccaggacctgagcaggaacctggagttttcaggtgagaggctcacctgtgagcaggatacctgcctgctcgcctattggtctccagattgactagttacctagctaacatctttcctagtacctgtttactttctttcctcccaaagcactgggattacaggtgtgagccaccgcgcccagctgaggctttggattttaattctaggtgtgttgagaaaccactggagtttttgagcaactaaggcacatgatctgatttacattttaagactcaccgtggcttttcatagagaaagattgtagtgggtaaatggagaagcaggggtcagtggagaagccattgcaataatccattcaagtgacaatgggggctcaggcagggcggttgcagcaatgatggtgagcagcaatggtttctggatatattttgaatggaatttcatgatggagtggaggcggagtgagggtgcaagctttctagaatgaactcaaagttgctggcttgaacttttgagtaggcggtagtgccattattgaggctgaagactgagggaggagcagactggggcagagtggaaggaatatgagtcaagacctttgttttggacatgttaacttcgagataccagccaggcgcagtgggtcacgcctgtaatcccagcaatttgggaggccgaggcaggaggattgcttaagctcatgagctcaa

SEQ ID NO: 406992 - DNA, 2178 bp, Homo sapiens
tgtccactgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattgggtctgggtgcctggtatctgaaccccttcttgtctccagagaaccccctattttatgagacttcatgggggggcaataactacctccacttaagagtacctgaaaatgctagacactgactttcccagcctccccttagctagggccaggcatggggaccagggataaacctgtgccacattttgactcagggaagggatcgggagcgctcttttgtgtggtaactgtgataacagtacccgcaaaattgagttcctggtgtagaagtgacaaggatgcaaactgtagcagttggtgctcagtggcagcaacgccatcagaccag

SEQ ID NO: 406993 - DNA, 359 bp, Homo sapiens
gagcgccggttcctggagccccgggccaggttctacgctgctgaggtggccagcgccattggctacctgcactccctcaacatcatttacaggtgaggcctgcctgtggctcagagccaggaccaagcccttcttgctccaacagctaggggttgtgtggacactaaatcctgatgaaatcctggtggacttggtcctttgttttgggtggggttggagtctcctcctccgaggtccaagtgcccagcctttctgggctctccttctgcatctctggcaacctccatgaatagttctcctgccaggaccaccccccgcccaggtctccaactctcctcactaaatggctgagacacctc

SEQ ID NO: 406994 - DNA, 427 bp, Homo sapiens
aacctctatgaaacaggaataatttatcctaggcaccagggaacccacaaatttttcttaagggcaatgaccagcaagcaaaaaatactagacacacaagaaagcaaggcaacatgaatgaaaattggtagaacaaaagagactacccaaatttcagctattcaaattagcaggcacaaattatataaatgataagtttgaaaatctctgtaagaaaccattaaatacagaaaatccctgtaagaaaccattaaataagatttctgtaagaaatcttaaatacagcagatttaagaaaaagcaacatagaaattctagaaataagccaagcatgctggttcatgctttgggaggctgagacaggaggattgtttgagatcagaagttcaagaccagcctggacaacatagcaagacccatttttaca

SEQ ID NO: 406995 - DNA, 979 bp, Homo sapiens
gtcatctggcctctacttaggtggcagttcccttgtgatgacaacctggctaaggattctcgcccaggcctctgaatttggagacaaagttgaaaatttggggttttgaatgtagacatgacagagtttttaaggaagggaaatggctagagtggagaaggttctatctcagggccgaccttatctccctgaaaggagaaagcagtgactcattagaatatgtttttgctctttcaaaagagccaggggtaggtgaacaactttcagaaagctgtattgtcccttccagaccaagccaggggctagaacagagcagatgtgtgactaggcaaacctgctaagcatggccttagcttccccatctgcacagtagagaaaataaactcttcccaaggggacagaggccagcagagctgctagtgagcggccaggactagggccatgctcatggttattattgggctcctaggaggagggcctagttttaagggtgcccctttcctgcacaggaggtgtggggtgttgcatgatgtaagagggagggtattcttggctctcggggtctggggccaccctgcagatccggacagctgacaaggctggggaatgtatccgggacatgtggctgggcttaagaggctccacagttcagctgtgatcatgattgttctttccaaggacaggccccagtcagtgaaggaagcaagggcacaggggagggagcacagatgtgctggatctggcggagaagggaaggggcccttcggggcaggtggccacttgcagaagagtggtttcccttgtcagtagtctttttttggttgggggaaggggaagtcatttcctgctcctgtcccaggagtaagctaaaatctattattgtaagttcatttcttggtggaggttgcagtgagccaagattgcgtcattgcacttcagcatggacaacacagcaagactcagtctcaaaaaaaaaaaa

SEQ ID NO: 406996 - DNA, 421 bp, Homo sapiens
tttccgaatcagatcctaatctggcaaccataaaaatttccaactcttcctttttactattttactaaaatttacttctactgtttgtgtttcaacacaacaaccaaattctaagagaaatccatcatagcctagtcttcataattctcttcacattaaaaacaaaaatggttcagctacttgagttggtcagcagtcaaccgcccctcccaatttctcattgttatcttcttacaaatgttcaatagccctaaaggttgaaagggaacacaaaaatgaacatattagcttcacacactttttagagaaagacagcacttgcaactaaccatgaacagcctgctaccttggtaaagcatcatcaatagcaagaagactgaaaggcccaaatgatgctgtgctcaagtccaattactatgaa

SEQ ID NO: 406997 - DNA, 632 bp, Homo sapiens
caacctggcactgcagctgctgtgactcatgcgcatggcatcaaggcagccatgcccaggcccagctcttacctctggggaagatagacagctgacaggtcaggacacagactttggtggcaactgcccgagcacccacatagcaagttgccgaggccaggggcatgcagagccaggaaaacctgggaagatgcataaacaggcccagcccaactttgctttctgtaggtttcaggttggcagaggaaagcaaataagtgaagaaagagtggtgggggaggagcattggacagagggaaggaggccaaagacaaactcttctcactgcctgtaagtgagcaggagtctgacccccggcttttctcccagagcctgcttctggctttacagttatcactgccacactcatgagcagtatttccaatactgcacagcaagaggggctcccaaggaaatacatgtagacccaatctcagcttaggcaaaaagatttctttgctacaggatttgtcagaaccttaaaatgtcaatgtattggaatgtctgcattcagaagggctatccgagacattatactaatgtatgatggtctccactcatgtttttggaggcctcatgggagtagtgtttat

SEQ ID NO: 406998 - DNA, 412 bp, Homo sapiens
gctgggcttccaccttctccatttgcccaacctgcagggaggatttgaagtcccctctgcctccactcagggaagacctgatagaactgaatgtccaggctgggcgaggtggctcatgcctgtaatcccagcactttagaaggctgaggtgggtggatcacctgaggccaggagttcaagacccgcctagccaacaatgtgaaaccttgtgtctactaaaaatacaaaaattagccaggtgtggtgcacgcctgtaatcccagctacttgggaggctgagggacgagaatagcttgaacccaagaggcggaggctgcagtgagctgagatcacaccactgcattccagcctgggtgacagaactgaatgtccagtatgtgggccaaagatccaagagaaagaaaaatcttaa

SEQ ID NO: 406999 - DNA, 719 bp, Homo sapiens
gctttattatatcaaaaataataaataagaaatgggataaactttattcctttttagtgacaatcattttttcccctccaaatttactaacactttcattctaaaaaaatatatacaataaaacaggctgtttagctaaacattatgaagttatgagacaaagatctccctacatactttcctcatttttgcagaaaacagatcataaaacagaataagccttgttcaaagaaatgagcagctttggttacaagtgcaaaagtcagccatgtgtactaattctcagtaatcatgaagcaaggtgagctccccagggacttaaaagtcaacacctagcaatgcttggatgaactaagatgaggaaccgctcatgtgacacaaccttacaaaaccctttgtattcccaataggacagatgaggctgtggaactcacaacaaccctctaaggtgtgtgactgactccaattatagagaagactttgccaaagcctgcaaagaaagatgctgctattacttaaaaaatgcatggctgggcggggtggccccatgcctgtaatcccagcattttgggaggccaaggcaggcggatcacgaggtcaggagattgagaccatcctggccaacatggtgaaacctagtctctactaaaaatgcaaaaaagttagctggacatggtggtgtgtgcctgtagtcccagctactcgggaggctgaggcag

SEQ ID NO: 407000 - DNA, 172 bp, Homo sapiens
tctcaccctccctctgccaacagaagtctgggcagggttttatgggctctgataaggccctggcagggccgaagttcatgagcacttcctctttgcaggcggtggtggctcttatacccagggtaagggagtgactgcaggggaggtccacaggctcctcttaaggggagcc

SEQ ID NO: 407001 - DNA, 1080 bp, Homo sapiens
ccactcgtgtgctccatccccacctgttgctcatcccaccttgtgctccatccccacctgtgctcccacctgtgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtggtcacacaaaaaataaaaaacaagg

SEQ ID NO: 407002 - DNA, 780 bp, Homo sapiens
tctcaccctccctctgccaacagaagtctgggcagggttttatgggctctgataaggccctggcagggccgaagttcatgagcacttcctctttgcaggagggcgtaggggaggggacccaggtgatttgggtcctggctggtcaccagggaagctggcaagggaagggagactagggtgcgctctaggagaagccgacagcctgagagtcccagaagaggagccctgtggaccctcccctgccagccactcccttaccctgggtataagagccaccaccgcctgccatccgccaccatctcccactcctgcagctcttctcacaggaccagccactagcgcagcctcgagcgatggcctatgtccccgcaccgggctaccagcccacctacaacccgacgctgccttactaccagcccatcccgggcgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgtgtccggccacgtttgacttctttctggtgtgagcagcctgttgctgaagaaat

SEQ ID NO: 407003 - DNA, 1435 bp, Homo sapiens
tctcaccctccctctgccaacagaagtctgggcagggttttatgggctctgataaggccctggcagggccgaagttcatgagcacttcctctttgcaggagggcgtaggggaggggacccaggtgatttgggtcctggctggtcaccagggaagctggcaagggaagggagactagggtgcgctctaggagaagccgacagcctgagagtcccagaagaggagccctgtggaccctcccctgccagccactcccttaccctgggtataagagccaccaccgcctgccatccgccaccatctcccactcctgcagctcttctcacaggaccagccactagcgcagcctcgagcgatggcctatgtccccgcaccgggctaccagcccacctacaacccgacgctgccttactaccagcccatcccgggcgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtggtcacacaaaaaataaaaaacaagg

SEQ ID NO: 407004 - DNA, 895 bp, Homo sapiens
gcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatgatatcttttctcatgatactcaaggcctcttaagaaagaagcttatagaagcatcattccaaaaagtgatattggatggatatgggagctgtggccctcagaatttaaacttaaggaaagagtgggaaagtgagggtctcctttacagaaaggggcttggataaggaggaaagaccatcagaagaaaagataagacactctcttctcattccagtaagagccacatgcaaggcaagaatcagagtccagctcagatgggggaactctaggaagagagaaatccattccatggacagctgccaagatagagcaggacagcatcaaggacatgagccaaaagtgcaaaaggactgcttgactttggaaaagaaaccaaaggcctctgacactgtacacatcagtgaaatgaggagacccatgatgcctgctgtgggggacccccagaggcccacaccgggcacagcgagcggccagatctcagtctctaggagaccacccactaccacttcagaaaagcctggtgacctctctgcacactccatctgaagccatttatcacaacacagcccaggtgtgggaacagtaggcctattctctgctgacctgggagcagctgtctgagctcacctggctccaggggcctctgtgctgtggtacaaacctgtgccatggccacccaggtggcctatgtctttcgcactgagggctggctcatcc

SEQ ID NO: 407005 - DNA, 958 bp, Homo sapiens
aacggcctagcggtacggcccgaatgctaggatggttgaagaagtggccagaaaaagaaaagcattttgatggcaggctggagaacatcgtgagaggaaacttcgggcctgttgactgtcatcttggcaataagtgttggatcctagccaaagtgcttggatgcaacatggagccaatcaataaatccatcccccatgcttttcctggccatgaggtaattggcagcctagttcatgtcttgatgggaagctctgccatgtggaaggatcacatctcaggtttcttgacaactggatgacttttgagaacagatctaggacagatctattcttggattgtggacaggcatcagcctactaacatcatatggaacaggtctcctttacagaaaggggcttggataaggaggaaagaccatcagaagaaaagataagacactctcttctcattccagtaagagccacatgcaaggcaagaatcagagtccagctcagatgggggaactctaggaagagagaaatccattccatggacagctgccaagatagagcaggacagcatcaaggacatgagccaaaagtgcaaaaggactgcttgactttggaaaagaaaccaaaggcctctgacactgtacacatcagtgaaatgaggagacccatgatgcctgctgtgggggacccccagaggcccacaccgggcacagcgagcggccagatctcagtctctaggagaccacccactaccacttcagaaaagcctggtgacctctctgcacactccatctgaagccatttatcacaacacagcccaggtgtgggaacagtaggcctattctctgctgacctgggagcagctgtctgagctcacctggctccaggggcctctgtgctgtggtacaaacctgtgccatggccacccaggtggcctatgtctttcgcactgagggctggctcatcc

SEQ ID NO: 407006 - DNA, 759 bp, Homo sapiens
gcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatgatatcttttctcatgatactcaaggcctcttaagaaagaagcttatagaagcatcattccaaaaagtgatattggatggatatgggagctgtggccctcagaatttaaacttaaggaaagagtgggaaagtgagggcaaaataatcctatggtgaaaaaaaatcaacaagataatctctgcatgagaaaaaggaccaaagacaagtgaattttctgagggtgatgaaagtgttgcttcgaaaaggggtgaagtttatatgggtctatttatttgtctaacatgtacagttaaggtttatgccttgcaatgtatgtacatcttcacaaaaaaaaaaaaaaaaaagaaaaaaaaaaactttgggggcgcggcgcggcgcccctgaaaaacgctttcaaacccctcccggtgtggcgcgcggggccaatgggtttaagggaccctgggcctagggggcccaagggaaacccggggcccggccccggggggggttccccccaaataaaaaagcgcgggggcaccggcggttcggacactccagtggggtccggggctccgggctctcaccggggcacgggcatag

SEQ ID NO: 407007 - DNA, 1276 bp, Homo sapiens
gcctttgttggctgcagtaagagctcagtctcttcaccaggggctcccagtccttccatctgggaggccaaggcggcttcgcgttctgagaatagacagaacctctgttactctgtgaccggcaggcaccgggagatccgtagctcagacgccaggacatcccggaagctgggaaatgggactgttgacattcagggatgtggccatagaattctctcgggaggagtgggaacacctggactcagatcagaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagatatcttttctcatgatactcaaggcctcttaagaaagaagcttatagaagcatcattccaaaaagtgatattggatggatatgggagctgtggccctcagaatttaaacttaaggaaagagtgggaaagtgagggcaaaataatcctatggtgaaaaaaaatcaacaagataatctctgcatgagaaaaaggaccaaagacaagtgaattttctgagggtgatgaaagtgttgcttcgaaaaggggtgaagtttatatgggtctatttatttgtctaacatgtacagttaaggtttatgccttgcaatgtatgtacatcttcacaaaaaaaatcttaaaaaaattaaatgggtgggggtagggaaagggttgaagtatagatgaagcagaagtggtacatgattagtagttgaagctgggggcaggtctatatattttatttttatgtctttaatagcatttgtataaatgtacaatattcgtttacaatgttagctcaggatcttgtttacctttggacagggagggagggagaaatttattttctgggtaggagtaaagctggttctattcctcagttatgtaaattatctgttataatccaaaaagctttacatgaatgtttctgtatgtaatgtggtatatcaataaaaaattaattacatactaatatcctctctctaaatagcgtttcccaaacattatctccccctcttatctcactatgttacttatttatcttcctttatttctgttaaagttcccctcttttttttttctatatttagtcttatttctttctctatagctctttccctagtttcttttttcatttaatatattgttctctcatgtttgtgttttttcccttcct

SEQ ID NO: 407008 - DNA, 1019 bp, Homo sapiens
aatgcaaagaagtgtaatgtaaatgctaaaaaaggagataattataaaatatttatttgcacaatatttatgtatcttttagtcataatagcccaaaacaggaaacaaccaaaatgtccattaataagaaaatgaactaattgtatagcttttagaacaaaatacagctcaggaatatgaaaaaccaagcacacatcctggataaaattcataaacctgctcaatgagagaaaagttggacacaaaattgtactttatgtattttgtattttattccaggcaaaataatcctatggtgaaaaaaaatcaacaagataatctctgcatgagaaaaaggaccaaagacaagtgaattttctgagggtgatgaaagtgttgcttcgaaaaggggtgaagtttatatgggtctatttatttgtctaacatgtacagttaaggtttatgccttgcaatgtatgtacatcttcacaaaaaaaatcttaaaaaaattaaatgggtgggggtagggaaagggttgaagtatagatgaagcagaagtggtacatgattagtagttgaagctgggggcaggtctatatattttatttttatgtctttaatagcatttgtataaatgtacaatattcgtttacaatgttagctcaggatcttgtttacctttggacagggagggagggagaaatttattttctgggtaggagtaaagctggttctattcctcagttatgtaaattatctgttataatccaaaaagctttacatgaatgtttctgtatgtaatgtggtatatcaataaaaaattaattacatactaatatcctctctctaaatagcgtttcccaaacattatctccccctcttatctcactatgttacttatttatcttcctttatttctgttaaagttcccctcttttttttttctatatttagtcttatttctttctctatagctctttccctagtttcttttttcatttaatatattgttctctcatgtttgtgttttttcccttcct

SEQ ID NO: 407009 - DNA, 725 bp, Homo sapiens
ttttttttaatttgctgtggatagtcattcttttaataccatcttttaagatccagctcaaaaactatcagtactttgacacttttgcccaattgcctttcatgtactgactttatttaacacatggcatttaattaaacttaatttaattaacaaaaatttatctctactacagcccttcaggatggtttggacatgggagctcaggcatatttatctttatatatccctggccccccttttaaagtttggtacaaagtagaagcacaagaaatacacgggaactgaatgaataagaggaaaattgaattacgatcaaagaagagggaccaggggaagtagggaaagaaggaagaacatagcacaatcctaaatgcaaactgtggtttccatagccgttggtagaggagttgtagtgaaaacttccagaatgtcagtaactctaaatatcctcaatatctcctgttggtggtttgtttgaaaatacttcaggaacctagaaggtagagtgaaggagaaatgtgatttgaatttcagtggcctgctgggtgttggttgtcaggacataatgaccaaagacaacctttaacttccttctgcttcctctgggggaatcacactgtcatggccaggaaagataccatctgttggccaagaaggataccatgtgtgaaatggaaagtccagatcaagtcttggacacaagtgaaaatatcttcaccaca

SEQ ID NO: 407010 - DNA, 461 bp, Homo sapiens
cataaatgggttaagaattgcccatctttttacatgagtgtcatgaataaaaattcataacctgccattccacgttttgggtatgtctttttttcatgtattatgttgttgctcttttaaaaacattttcttagtcttttgatataggaaaagtaattttattattttattttttaagagaccaggtgtcccttgttgcccaagctggagtgcattaaggggacaattttagtttactgcagccttgaactcctgggctcaagccatcctccctcttcagcccctggagtaactaggactgctagcattccaagccagtttattttaatttttattacagatagggtcttgctgtgtttttaaagctgatctcaaaacaccagggacaaagtgatcctcacgcttcagcctcacaaagtgctgggattacaggtgtgagccactgtgcttggccccagtta

SEQ ID NO: 407011 - DNA, 1047 bp, Homo sapiens
tgagtctggaaattctgtctctagaggcagtagcattttgaggcaggtcctatctcactatggtttctgccagaactgatttcttgccatctcaaggccttagggctgtggaaataaatgatcaaccaaatgagaaaaggaaaggctattcttagcttactatagcaagggagttagccaccatcacctgggttttggcagaaagtcaaaggcgggcagatgggtggaaaagttttatagcagaaaaaagggaagccttcagatatgccctggttgaagactgttggcatagggaagccagaagcaggttgactggagtcagtgtttcacagtgggcaggtctgtgtaatcctacatcaaagtctaaggaagttgagaggccaaagaggcacccagtttcttagaaagaaacatttaatagggatttaggaacagaagccgtgactatatcttgggcagtgatgaggcaagttggtggatcccagcataattacccccaagacctgggacttttatgccatagggagaggagtggttgaaaaggaatttgtaagacaattatgataacatcaaagctgtttgacctaagggcaggatttactgtatgtatgagtttatcaaggtgtcttactctaagggcaggatttacaataagtacctgctcttaaacaaggttcaaatagataaattggaatgagggttaatcagaagctaacagggcagattagcatccaagatggagttgctttggcctctagatggggcatcctgtgcaatttgctaaggtgcttatttggctttctctggtcctaagttggaagcaggggcaaacaagttattgtttagcttcctggattgtcactaaagaaagcaatctggtttcctgcaattctgacttacagcaggctgatctcctgggttgtttattgttgatgagggtgttggtttctcgggcagcttgctgcaggttgtgggtcgaatttctaattttacatatggcatggccactgtccatttctatattcagtctcttagggcttctggtga

SEQ ID NO: 407012 - DNA, 343 bp, Homo sapiens
tcctgtgcaatttgctaaggtgcttatttggctttctctggtcctaagttggaagcaggggcaaaattaaagaaactgtcattcattcatttcctgacgattctgggccaattgttacacaagttattgtttagcttcctggattgtcactaaagaaagcaatctggtttcctgcaattctgacttacagcaggctgatctcctgggttgtttattgttgatgagggtgttggtttctcgggcagcttgctgcaggttgtgggtcgaatttctaattttacatatggcatggccactgtccatttctatattcagtctcttagggcttctggtgagcagtaag

SEQ ID NO: 407013 - DNA, 415 bp, Homo sapiens
tagattaaggaaaataatgcctggaaaatcttttgttttagtacagggctgagaaaacttgatggtaaataatagaggtttcccaggccaataagcaaaattgaagatatatgtaggcgtttacataacaaaggagaaccctctggcgagcctctccctgcttgcccccagagaaccatccggagtagttagcatgtttcatgtccagctgctgcttgccaaaaacattctcagaacaagagggactagcccaagagggaaagggctagtaggtatggtgaaaaaggggcagggtggctgggtgcagtggctcccacctgtaatcacagcactttgggaggctgaggtgggtggattgcttaagctcaggagtttgagagcagcctgggcaacatggcaaaaccctgtctttacc

SEQ ID NO: 407014 - DNA, 429 bp, Homo sapiens
acattttcactctctagtacatacttgcaatgtcagttggccacagtgcaatcacactgctatttcaaggtgtgtgtacttgacatgttaacaccccatcagatgccagacttgtggtgaagggccaagagcttctgtgctactcccttcctgtcctgtttatgttggactgcagcttcaactccaacgtgtggctttggcaatagaacttacaaagttgaacattatcccgtccttcaacctctactagttagggttcaagatctcactatattactgtttgacattagtatacaaatggtttcttaggttctgttcttgtataaaccttacctggttgattgaaaagcaaagcaaaataaaaacaaaaaggacaaagacaaggtaagcaaaaacaagttgggacaaaataactaacaaagggtcaag

SEQ ID NO: 407015 - DNA, 2292 bp, Homo sapiens
tgactgttttcggactcagcctgcctacacccaggtgattaaaagctttattgctcacacaaagcctgtttggtggtctcttcacacagatgcgcatgaaacccagtaatctacttcaagtttcctagctcttccctatgccatctccattacgtttgtgagcctatccagtattttatttcaattattgtctttttatttctaaaatttccaattagttctttatatcttctgtttctttgttgatatttttctatctttccattcataccccagggctgagggagcacatccaaggaagggccaacttggaaggggttcagcccatcagatagcaggtaagtcctctggtttgggcaggctagtctggagttgctgggtaactaataggagaacccctcaagtgcaggtagggatggccaatcagcaactggtggcatgggcatgtgatggaagtccagatggccttcagagtgtgtggaccacacaggcacttgcagaaggcatcgcaggttggcatgtgaccctcaggggcacaggcagctgtgtgcaggtaatatgcaggcttgtgaagaaagtcgaaatacaagcacaggcaggagttcttcagagcacgtgggctgcacaagggctctgtgttctggctcaagagagctgtagaaaggtgactgcaaggccaaggatgcaaagtcgcaaagggactgttctgagcccatgcttggggcagattccgatggatattctcacatgcacactgctgatccccagcccacgccaaaaaaaaggcaggaagcctcttcctactaccttgcccctccagtgccttctactgagaaagcacagcactgcgctcactttaaagggccaatatttaaaggaatgccattgtataacacagggtatatttattgagtggcgcattcaaagctgagaagcagtaagttgataactgacaccgtgggtaaccaatttggttgagttctgacctcaaattccaacctgccttctgtggggtgtgatccccatgtcaggtctgttttcagtcttcgtggtgctattcagctatgttccgtgtgcaccacccagtggcccgtctacggcgtggctgaaggtctattccagtgtccaggtctaacttctttggagtgctggttagggtcagatccacgcatgcgcagctaggggaggagcccaggaacaaacttacggagctgtttcctccaaattcctccctctctgtgatctccctggtcctttcctgatcgctgggctccctttttcgggcctctggccaaaaacttggtgttgtagttaccctgctctgccgtgcacttcctacaactgcacccacagtcgcggccaagcagcgaagatttaagaaagtaagaaagcgtgacggtttgctccactcttttgggctatagctcctccaatcagaaaaggaaggttctctgcatgtcccactttatgtgaaatctaacaaagttgaactcgtagaagtagagtgtagaaagagattggggccggggaggaagggaatggggagttactggtcaaagggtacaaagtttcagataggtaggaggaatgttttgaaatctattgcatagcagggcgactatagtcaataataaagtattgcatatttcaaaatcactgaaagggtaaatttcaaatgtctaccataaaaatgataggtaaaagaagtgcatttaatttttcttttaccacttttcttactctgttatcttcagctcaggagtatctaacctgcaaagatcttaattaaggctttggctttcgacttaaaagtctccataaaggaacgctacgcatcatcctgaaaataaagatcaaagtccacagccagtggtgaagaaacattaataagagaatcagtcagcctagtttttttgaggaaatctgtgcacagatcccaagtctacacataaaccaaaaagccaaagtaaagttaactgtatttgagcagtgtgggcagcccagccagccacagtaactgaagctggaagaattactccctacacacagggctcgtgttctctagatcaaccagacacatcacagactctgttgttgaggttctttcatttcctcaggccagttagcccttggctagtagccagagctgtacattaactgcccctacatttttaaaatcattgcttatgaatttctatgtattaacttagagaaatgtaattctagttcccatcttagaggaatggtctcttcttaatgtctttgtgttctaaatatttgatcatgtcaaca

SEQ ID NO: 407016 - DNA, 1209 bp, Homo sapiens
tgactgttttcggactcagcctgcctacacccaggtgattaaaagctttattgctcacacaaagcctgtttggtggtctcttcacacagatgcgcatgaaacccagtaatctacttcaagtttcctagctcttccctatgccatctccattacgtttgtgagcctatccagtattttatttcaattattgtctttttatttctaaaatttccaattagttctttatatcttctgtttctttgttgatatttttctatctttccattcataccccagggctgagggagcacatccaaggaagggccaacttggaaggggttcagcccatcagatagcaggtaagtcctctggtttgggcaggctagtctggagttgctgggtaactaataggagaacccctcaagtgcaggtagggatggccaatcagcaactggtggcatgggcatgtgatggaagtccagatggccttcagagtgtgtggaccacacaggcacttgcagaaggcatcgcaggttggcatgtgaccctcaggggcacaggcagctgtgtgcaggtaatatgcaggcttgtgaagaaagtcgaaatacaagcacaggcaggagttcttcagagcacgtgggctgcacaagggctctgtgttctggctcaagagagctgtagaaaggtgactgcaaggccaaggatgcaaagtcgcaaagggactgttctgagcccatgcttggggcagattccgatggatattctcacatgcacactgctgatccccagcccacgccaaaaaaaaggcaggaagcctcttcctactaccttgcccctccagtgccttctactgagaaagcacagcactgcgctcactttaaagggccaatatttaaaggaatgccattgtataacacagggtatatttattgagtggcgcattcaaagctgagaagcagtaagttgataactgacaccgtgggtaaccaatttggttgagttctgacctcaaattccaacctgccttctgtggggtgtgatccccatgtcaggtctgttttcagtcttcgtggtgctattcagctatgttccgtgtgcaccacccagtggcccgtctacggcgtggctgaaggtctattccagtgtccaggtctaacttctttggagtgctggttagggtcagatccacgcatgcgcagcttaaatgttttctcctgtctcctcgtgccg

SEQ ID NO: 407017 - DNA, 372 bp, Homo sapiens
agaggaccacagtctcacattttagggacacaggaggaggaggagccacaaaagctggcatcacagaagccagaggagaagagtttcaaggaggatggtgtggtattgcagagaagtcacaggggatatagactgggcagtgctgggattggctgtgagcatttgactatgagaggggccagtcaatgtcaggtagcagtggattgaccatgtgaggggtcaggaagcctaactctgcttctcatgaatgaaggggttccttacagcccaggacatgtgtgctaattaccaggtagtagaaatattactggaaatgcgctgaatgaacgttcttgcactccacatacagactttgttgccagcctttgtgta

SEQ ID NO: 407018 - DNA, 525 bp, Homo sapiens
cggagcagagggcacacacagtggagggcacacacagcggaggacagacacagtggagggcacacacagtggagggcacacacagcggagggcacacacagtggagggcacacacagcggaaggcacacacagtggagttacctctgatccccatgccctacggggctgccaccttcctgccagggtttggatcatcacagtcatttgcatcttcactccacagcgtgagtgcacatacacatctgttttattgcatttggcccttataggaatgagtgggatatggggaaatgaaaaggctgagactgcgataaaaaatgtagctcttaggccaggtgcggtggcacatgcctgtaatcctagcactttgggaggccgaggtggacagatcacctgagttcaggagtttgagaccagcctggcgaacatggtgaaaccccatctctactaaaaatacaaaaattagccaggcgtggtggtgggtgcctgtagtcccagctactcaggaggctgaggcaggagaa

SEQ ID NO: 407019 - DNA, 359 bp, Homo sapiens
agatttctggttctgcaaaatgtatgctttatttatagattacactcagccacattaatcaagaaaacaacatccagtctccccaaatcacgatatttgtctttggggatgctatatatttgtggttctcatgaacatggtggccctgcacgaagaccacagtgggttcctggtgggtgtacgctgaatgagcctcctgattgtgccttgcttcaatgaattgtcagttttgctcatattccctgagtatccaccagctggggtggaagacaacccgttcccagacgctatggataatccacatgtgggtgagcaagagttaagtatatgtaccaatgggcagtgggtgagtgtacaat

SEQ ID NO: 407020 - DNA, 373 bp, Homo sapiens
tttcagttaatatcaagctttgttcacactgatatattgattgggattcttcaaacgaagaatgaaacattattgacttatttctaagtgtaataactcaataactaaattgagaattttcttgttttttgtgtacaattaaattattccattttatatatacttattaagttataagcatgttaataaggagacttttgactgtccagcctaatggaggatctgattcccattaaggatgtgggaattcccgtattttcctcttcaggtttttttgtttttaagtctacagagagatagaaccttaacattgcccagtttgataaaagtgaaaatttgctcacctatacaaatgttattttacacaattatt

SEQ ID NO: 407021 - DNA, 401 bp, Homo sapiens
gaaaaaaagaaaaaagaaaaagaaaagacaaggaaggattaccacatgtcatgccacattttggtgggaaaagcctgaacctggaagccaaagaaaaaaagtatctgagcaacaaaacccttctaagggggcttactgacactgatcacttagtcttgagttccccagcctcatgtggccaaaaggacagagtcaaggcccagggccactcaagaagaggaaacttggggataacattttctatgtcaaatgaaccccaaaacactacataataaaataaattataaacagaactaaactcctcctacttcccagtagtaatggaacagggaaacacaaacaaaagagcaaaaagagagacagaaaaaaagagaagaaaagaaagggaagagagcaagaga

SEQ ID NO: 407022 - DNA, 551 bp, Homo sapiens
cttgctggactattttggtagtcagaaattctctaaagataaaggaccacattcttgaaaggcataagaagtgcctaagtggccttcctcgaatccatcttctgtactgcccattgaatctgcttttctagtgcactttgatccatcgctcacctgcttaaacatatttcacgtcttaaagtttctctccagctcccattgccttaccacataaaacagagttcttagtatggcagatgtattaggactctttccattgaaaatggtgggaaccgaacttaaactcactgaaacaagtcggaattcattggcccatgtggctgagatattgcaggtcacttgaggaagtgaaggaagtataccaggaaccatgaccgtattccctttttgggacagaattcagcattcctaggactcactctttttctgtttgtatgtcatctctgcttgctcttcttttttcatagtgggctcatttcctgcaaatgcaaagaagccttctctactgagcagataacttaatcgtaggcagcccttgcttagccacaaaa

SEQ ID NO: 407023 - DNA, 616 bp, Homo sapiens
gcctcaccagcatcatgttaaatggggtattggcagttcctgaagtaagaaaattgtctaacagagctgagtcacagagaaccagaatcagggcgtctcatgttattactgggagagtttctgtatcatactcattccagactttgatcgctgactttaaaatctttgttcattggcttgacagtaatatccatggagttgacctgcctaccagccactcacctgagcttcagtgttttttgactctttaaatgccattattttcttttccattccacttttcactctgatggatatcacttggactttattattacctgaaactacttaattcctgacatcctaaatgatggtctcacccttttgaccacaaccttatatccattcaactgtcttaagccctcaatctcactacattctgctcattgattctgcaagcaagacctttgggatcaccagcccttcttagtctcacaagttccatactaatctgcactatatggttgatttcctgaaatacccttgaacatccctacttccttatccatgtcctacaatcatgcatgtattagtttcctaatgcagctgtagcaacatactacaaactgaaaggctt

SEQ ID NO: 407024 - DNA, 504 bp, Homo sapiens
tctccttttgtatcagaagctttctggatgctgaagtggagtgtaatgccctaaaaagctgactataaactctgctggctgtagtcttcactgagggtgatggagctgggccatacagttgggaaaccacttatatcagtaccattaggtcttcccccttgggctggtcaaaccatagcgggagcaaggatatagctcaaaattcagtatgtatgtgaacttccagttaatcctactgatttctgtatggaatatttaccttcaataaatggctgctctccctagtcaagagatactttgaattactttcctcagagaatgaacatccagcctttcgttagagcacagcacaagcagttgccaggctatgtgaagtaagttgaaaatctaaaggtctaattgcttcttaaacagactttaaaccaattataagcccgtttgcatatccattttcatctctttctggtgctcccaatttttgaggctttggggagttctgtagta

SEQ ID NO: 407025 - DNA, 630 bp, Homo sapiens
ggaaacagaatttcaaaagagagcccctgttagaaaacaaaacagaacttctcgtttctttttctttgtacatgcttcttatcaagaatatatactccacaataaaaaatcatgttgctaagaaagcccagttagtttcttttgagaatctgatttgagtacactaatgtgtgaattgaatccgagagaaaaataattcttctttaatgacatatgtctgctaatttgtccagcagccatagacaggccgaacaaagataaaactgcaaattcaaaccttatgcttggtgtgaactgctgatgttgagcttttcctcctttgctgatcaatttgacctgtttcgtgacagcggaaccagaagaaatcattggaaaaattttggagattgagttttctcccagacggtagctgtcaccacttgttcagggttttatcaccttagaaactctgccaggagaggacacacccaggtctgagctgatgggctggacttgccctcttgtttgtcatgagcaaacttgatcattttagtgatcttaaatgtaagccaccttctcactcagtacttaaagtctgctggagaaaagacacaaacttgattttcttctctgtctaaccagactgatcac

SEQ ID NO: 407026 - DNA, 574 bp, Homo sapiens
tgaagcattaatggggtgctatcaaatcaagtactatttgcgtctccaaatcgattaatagttacctaaaccaagacattaagcatctttttccttctgccttctttaggcttgtgttacttgaagttttccttgtcagcttgagcaagactttcattttggtgttagcattaaaatgattttaattagccaagtctatataacatttatgaagccttattagactgtaaataattttagatgcaaacgtgattgtgtgatttaaacaaacagcccttctttacaacaaaaaatagttttgttttgtctattgtaaatccttatgcaactgggatggtgatctgcatataaagtagttcagcttttcaattccttattaaagcaagcgatggcgtctgaaagaagcacactgtttccttttcataaataggttactgcacataataatcctttatcgtcatgtggagattgaagtggatactgataacttacttttaaagctttaaaattaccaatagtatattgtctgtcactataaacaattcatgtgataggctttcaattagaaattcct

SEQ ID NO: 407027 - DNA, 358 bp, Homo sapiens
gaggacggctcgcgtgagtccacgtgtaatcggcccgggcccagcactggcgggactgacgcagttcttctacctgctttcccaagggcgacactcggctccactccagttgggccgctggacgccctaggggcccggcagttgctaggcaacgccggaagccctcaggaacgtagttccacgggcgacgtaggatggcggatccggatggggcggaccccaaagctggctcccaactccgctcaccccctcctatacagggctcttggttcaggtctcttggttcgtcctgctgcaagttgggaagaaagataataggaatgctaattccttcttgatgaaacgaccacaacacgct

SEQ ID NO: 407028 - DNA, 448 bp, Homo sapiens
gtctagtatttggagacagggtctgtaagaaggtgataaaggttaaattagctcataagggtggggctgtaattcaataggacttgtgcccttaaaagaagaggaagagacacttgagctctttctgtctctgccatgtgaagacacagagaaggcagccacttgcaagccaggaagagggccctcaccagaaaccaaatcaagcagcactttgattttgtaattctcagactccagaactgtgagaaaatgaatttctgttgtttaactcacctagtctatggtatcttattatggcagcctgagcagactaatataagaatcatacaaaggtgataccaatcactgccccaacccatattcccttttaaaataacccaccctggcccactggtccagctgccctgtgggcaacatgctcctggtgccctcagtttattgaccagag

SEQ ID NO: 407029 - DNA, 442 bp, Homo sapiens
atggttattacccggtggggccaaaattctaggtagtgatttaaggcaaagagatgatctccaccagccttccttcacatccacaaatcagcacaaataatccacaaagcagcaatagaaatgtaagccagatgccaagaagaacttcctgactgcaatgttagttgactgtctacctgatgtgaaggaaggaagctttactagacatagatttcatgtaccctggagctgagtttctagtcatatattatctaacatttgcagagggattgtgaagttttgtcacatggtcacatatatctcagcattatcacatatatctcaaactgagcatggtcacatatgtctcaaactgaggcccagagaacctttatcaattgaagttttttcagctgcagttttcagaaaacataataatcagggaaatgcattctcctacttc

SEQ ID NO: 407030 - DNA, 351 bp, Homo sapiens
taaatgcagatggctcctgttgaggtaattaaaatgtaatttcgtttgacaatgaaaccaaatttgtctacatatatcttctccatcattggatactaagtgtatagatactctcatatggagaaacatgggcatgttttaatgttaaaaagagcctcttaaactgaaaaaagctccagcttggtgtacttgttgaaattacagattatgaaacgacttttagatcttctgaatcagaatctctaaaaaagggcctggggagatatgttttattgatttatttttattttttgagaaaagcggcgctatattgctcaggctgatctcaaaatcctgactcaagcagggctg

SEQ ID NO: 407031 - DNA, 423 bp, Homo sapiens
tggagagggagtctcactctgtcgcccaggctgaagtacagtggtgcgatctcagctcactgcagcctctgcctcttgggttcaagttcttctcctgcctcagcctcccaaagtgctgggattacaggtataagctgctgtgtctggccaagactttttgtaaagcttgtttagggtgagtctatagtggcctttactctaactaagtactgtttatctctgctgctaaggcttgactcttccgaagtctccaccttaattcccaggtgtttaatataaagtctctgcttttgtggttggaggtcaaatgtctctcagcctagcgtgagctctggggattgcttagcttagagctccatggtagttctttgtacagacttatggagcctcccagtgcctcagcagtgcagtatttaagcaaaa

SEQ ID NO: 407032 - DNA, 157 bp, Homo sapiens
tactgtaaattcctaaggtatttgttttatagtcaatatatctcaataatggaattttgggtaaattttacaagaaacaattacaaaattggactgtattaatagtttctttatggtcagagtgttcacaaagtgtcttaaaaataattttatatcc

SEQ ID NO: 407033 - DNA, 419 bp, Homo sapiens
cctctcttccctttcctgacctttagtctttcacttccaattttgtggaatgatattttaggagtaacggatttttcaagaagaagaagaaagaaagactgaatttccttgcttattttgcatgtacagactggatttttttcctaacagccatttccccaaaggaatgtgtcttgcgtattactgacatttggtacgtttcattcattggaatatttcttactttctgtgtgtttcaaaagcctgtgagaaatacaggatttgataacattttgaaggcaggaaaaccccaaattgttacttctttgagagtcacaaccactttctggtgtggagaaattgccattggaaaatttgacaattttgattctcgctggtatgtttaaaaactgaataaaaagaatagaatttttcttttg

SEQ ID NO: 407034 - DNA, 437 bp, Homo sapiens
acacacagacacacacaaatctattaaatatgagaaaattagagaactcatcattatatatgttaaatactttcttcaattagatagtaagtaaaaacgtgtacaattttgttgctgccaacataatgtgttgattcatttaaaggtaaactagtattataaggaataataatgtactatttctttaaagactataacccttctttaatatggctttaatatttgtattacacactagaccaaaattatcacgagggacaaaactgtgtgttttgttcattttttggtgcattgttgtattcaaagtgcctggcatatagtaggcactcaaaagaaaagggaaagggaaaaggaaagaaagggaaaaaaacaaaggaaaggaaagaaaggggaagggaagggaaaaagagaacggaaggagggagggagagacaggg

SEQ ID NO: 407035 - DNA, 540 bp, Homo sapiens
ctccaaaagttacagagtttactgtgaaaagtcttccttcagtccctgtcctcagctgcacagttcccctctccaaagggaatcggtgttattttcttgaaacattttttggattaatatttatctaaaggcctgattttgtttggctttatttttaaggttggcattagtaaacgaatctgttctggttacttttatactttgataaacatctcatttccattctctagcctatgctattctctcattttctcctccatttcctaattgatggtactgtagagccaaatagagtgtcgcttactggctttgggaccttactgatctgatgcatgtttttctaatctgtgaaatggtgaaaacatctacctctcaggctatagtaaagatttaattagagaatatttaaagttcttttgatgtttgttacaaagcaatagatatttgatgattagttctcagtttttctaaattttaaagtaaagaagtaaaatactgcctttcatttctaaaaaattaaagttctgtatatgtgaacat

SEQ ID NO: 407036 - DNA, 388 bp, Homo sapiens
ctctcataaagaattccagaaacaaggcttctgacccattggtttattgagttcagttcataattattgggtcactgttgttaccctggacatctgaatgggtggaaatggtaatttagattaaataactacaggtaaggatcatcagttacatgtcacgatcacctgtaaaattctgtgatgaccaaagaggtgatgatagggttgggttaatggtaaagaagaaactgtcagtgggatttgaaagtgggacagcatgtcagtaagttaagtgctttcaagattgagatggtttctgtctgagtggatatatgttaatgtgttggagaacagctctgagccttttgaagatatcttagccataacagcaaattatggattcattagg

SEQ ID NO: 407037 - DNA, 245 bp, Homo sapiens
ggtgagactctactaggggccaggaaaagagtagtaaatgaaaaatggcctttgccttaagagcatgacctgtgaggagaccagaatgcaaacgggcaattgtagtgcaagatgcgaagtaccgtagaaggcctgagcacagcaacccaagggagctcacagtgagggccaacattggttctcagaggaagatatttatgaactaagacatgaaggaaacaagaaggaggtcatcaagtgaagca

SEQ ID NO: 407038 - DNA, 509 bp, Homo sapiens
cgaagcaggaggggagattccaggcagaggaaactgcttggggtaaagaaaacaaaaaacgcaacccccccagcatggtgcgtactggagatgagaaaatggaggtaccaaaaagtgggctctgaactgcagagcctggctccagagcccttgtatttgactactgggatccaccgttattctcacagccgcgtttcccacagggctgctttgtatggcctcttagaaaagtcctgcctgtctccaccatccagactatgatgtccgtgaggtcagaggaaagggagaatgtctcacatacagaaaatgcttgatcaacattgatggaatcataaatgggcctcagcggcacctgtcctgagtcagcatctcacagaggttttgccagcgccagccacatctccagcatgaaggtgattgtctgagtgtgtccagtccagttcctgccttaataaaaatcactgctgcaagggagagggctgccaaggccctgcctccctccaacccca

SEQ ID NO: 407039 - DNA, 214 bp, Homo sapiens
cgaagcaggaggggagattccaggcagaggaaactgcttggggtaaagaaaacaaaaaacgcaacccccccagcatggtgcgtactggagatgcagatgctgtggctcaaaggattaattaatttgcttaagataatgcaacatgagaaaagcagatcaggacggaattccagaacaaggattttgcttgaaataacatcactactaattgtct

SEQ ID NO: 407040 - DNA, 351 bp, Homo sapiens
caatggcacaatctcggcttactgcaacctctgcctcctgggttcaagccattctcctgcctcagcctcccaagtagctgcgattacaggcacctgccaccatacctggccaattggtgaaacccagtctctactaaaagtacaaaaattagccacgcgcctaatcccaactactcgggaggctgagacaggagaattgcttgaacctgagaggcagtgagccaggatcgcaccactgcactccagcctgggcaagagagtgagaatttgtctcaaaagaaatggggtggaatcaggtgtcagtgtccccagctttcatgaaaagcataaataaaacttccttcagctaag

SEQ ID NO: 407041 - DNA, 258 bp, Homo sapiens
gcagtagcagtttacatagtacagcattctgcaaaaattgcatgaaatgtggacacaagatgtactgtatgacttaattacctgtcattctctgacaccattactacctactagaagttcaaataatttatctttaacattgcaatatctgataaactttttaaaatgtaaataattcaaagccttgaaaatctatcatgaatctgctcaacatttcaaagtgactattttgaaatgcctataaatgctatatacctg

SEQ ID NO: 407042 - DNA, 209 bp, Homo sapiens
aaaatcaggagcaagacaaggatgctcacttttagtactcctgttccacatagtactagaagtcctagccagagcagttagttatgatgaagagatagagaaatacttattgggaagaaaaaggaaaagaagtcttggtttgcagaagtcatgatcatatagatgaaaaaaaacctaattaacacctccaggaaaaattattagaacca

SEQ ID NO: 407043 - DNA, 255 bp, Homo sapiens
gaaggccagaatttgaagctgtaggaagagtttcttcaactccagattttttttaaaagagcactcctctaaatcacctgaaatgttacaaggtagtggaacagaactgtgaatgtttttaaaaactgacaaacaggtatttttaaatcaaagaataatttagaaatgtatggatattaaataccaacattattatgcaaatgctcttagttataaccttaaaataggcagcttattaccttttttaacaaacaa

SEQ ID NO: 407044 - DNA, 422 bp, Homo sapiens
ttccaaggatgcttgcttgtaaaaccattcctaaattggcttctgtgattagagcatgtgcagaaatgccagaccacaaagaattatcaccaaagacaacttcttctcaaatatgaataagatggcatgttatagatgaagttcacatttgaagcatctgaacatggtaaaataatatgatcaaatgaggttgcgtctctgagattctcatgaaactgggctacagtcctggctacttaccctcaaacttttatcataaaacacaatttctgctatgttgaagccatttttattttgtggttgtttttacttaaagtggaaattaatctttattgatgcaattgctttttgtttcttgtcttaaaaatatgtcaaaataacataacctgatataattgaattggcaaaatgtaaaaatgtac

SEQ ID NO: 407045 - DNA, 283 bp, Homo sapiens
ttaagtctacacatctctgtagcaccccaattaaaatgagagaagaaaaatggagagataggaactacatgtagtttccagtgtggaacaagtggatggtatttattaacggtgacaaggaggatgatatttttaatattttaactccctgttgataaaagtgaaagagtctaaagtttagaaggggttgttagtgatttagtgatgacctaaacaagcaaatgtggacttttcaatgaaaacctctttgcaggggtggttgaggtcatgttagccagtaatc

SEQ ID NO: 407046 - DNA, 229 bp, Homo sapiens
gatatttcaaagcccatagataactttggctgtttcaggaaagaaaatctatcaaatttctgggaagcaacagataatgggcaagagacctttgggatctacgtgatggccaactaacaatgtgtgcattccggtttgcatgttggggttatttaccatctagtttcttggacattgttacatgcacctcataattacacagtaatagaatctagctctaagggcagga

SEQ ID NO: 407047 - DNA, 318 bp, Homo sapiens
gtaattggagagggtttggggtatggataacagcattgaaaaggcccaagtcaagaaagcatttgaaaaattgaaaaaggtctaattgtgtttggagcatagagtgttaaggacataggtgaggtggcaagcagggaacgaatatctggtgatactgaaaaccatatcaagaagtttgtacctcattctaaggccaatggcagcacgctgaaggacgttaagtacagggataacacgatctgatcctcattttggaacgttaatgcaggtgactgtcggactagaggctgtttcagcagtcctggtgacagaacgaac

SEQ ID NO: 407048 - DNA, 417 bp, Homo sapiens
gtggttttatttctacagcaaatcaacatgtctgctggcacctgatatagagagccaccaagccaatatgtgcctttttctctatacctgcctgtaaatgtcatccacagaagtttagtttggtagggccatcaatacacttttaaggtcccagctcagttctgtatctactttccagtatttttcacaatttacccagggattggtaaactatgtttcatggactaaatctcctgcaacttgtttttataaattgtctcattgaagcataaccataaccagtttttacatattacccaggagtgcttttatgctaaaatgacagtgttgagtagttaggccacagagatcatgtgatctgcaatgcctaaaatatttactgcccggctctttacagaaataactttctgacccctg

SEQ ID NO: 407049 - DNA, 325 bp, Homo sapiens
aaaaaccttggtgatgcactgcacgctttaacataataccctatttcatttattcttgatggtgattctagaatgtaagtggaattttttgccatctatggataaagaaacagaagctctacagtactggttgtatgatttgcccaaggccacatactagtacatgatggcctccatatttgaccccagatcttctggcattagctctaggaatgttgtcattacaccaacagctgtttctccaggtgttaacttgcttatgcatttttaatgcaaagtcacaatatcaggatagtaatgaatgaaataaatataaatgttactt

SEQ ID NO: 407050 - DNA, 470 bp, Homo sapiens
gggaaaatatcaacaagaagagaaatgcgactgctcttcctatagaacagccatctttttttttctttacttctctaacaaacttactttccaaaaaaaaaaaaagaagaagaagaaggaaccaaggaagggagggaggcaaatgcttgacaaaatttccccaaataaagcagtgcccgatttatggcacagtcgcgcatggccacagcagctgtgctgtactccccctgcagcatatcccctgctatgctcactccgcaactcattcaaatacctacctatcaaatacacaagacttgataacacagcctggggatggaaatataaacagaacaggtcctaacactcaaaaagctcagcctcgtaaccacacagaatcatatgataaaaatgtttttatggtatatggtgtatcatcactggatgctacaagagtaaaaaagatggagaaactggtgaagctgaggcag

SEQ ID NO: 407051 - DNA, 406 bp, Homo sapiens
acctcagtattctcagtggtcaaacaggggagttggtctagatgagaggcagccaacctaaatgcctacggaaccacagcaggccctggagacaagtgaagagatctggttgtaaaatcacagtgctgcagtgtcctcatcaaactgaagagtaggagtaagagctccttcaaatggttcatgcctgtaatcccagcactttgggaggccgagaagggcagatcacaagctcaagagattgagaccattctggccaacatggtgaaaccctgtctctactaaaaatataaaaattagctgggcttggtggcgtgcacctgtagtcccagctactcggaaggctgaggcaggagaatcgcttgaacccatgaagcagaggttgcagtgagcccagatcgcaccagcc

SEQ ID NO: 407052 - DNA, 604 bp, Homo sapiens
aaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaattta

SEQ ID NO: 407053 - DNA, 380 bp, Homo sapiens
gaagcaaatgattttgaaatttttaaaaacatgctgttctttttctgttaagattagtctacaataaagcgtatacttgcagtgctctgttaagaacatggatgaatttgtcatatcctttctattctgtatcttatagtaagtgcttaactattagttgatgtaacaactacaacttagaatcatgacccacagaagccaaacatgctaaccaactcagattactagcatatctttaaaaatgtcatatattccttcctttgtgtacttggaattgtgcaatatacaatacatggattatagatgatgcaattttatgtgtgtgagagagattaatcagtcttggaatatgatcttgaatttatcttaaaatatctgca

SEQ ID NO: 407054 - DNA, 451 bp, Homo sapiens
atactttcgggagagatatgtgtggtggatggcagtgggtgaatgacaaaagggattgggacataaggtgatcttaggcaaggaaacaaaacagataaaagcactggacaaagcatagtactttcagaaaccacaaattggtgtgctgggagctcatatgtaggtgtgagatgagataaggctggggagataatatcatggaataatactatgaaggtttctatattatcagtatagagagtatggattttatttaccaacaatgaagagccattgaaccattgagcagtttaaccaggggacaggagagagttacatttaaaaaaattctggaagcaacagaatgatgagatagatttctgaactaaagcagtggtcatggaaatgagaaggaggaatttaaaagggatttagagtttcatcatttgagaaacaataaaggtgtacaatg

SEQ ID NO: 407055 - DNA, 762 bp, Homo sapiens
gtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggccaggagtggtggctcacacctgtaatcccagctctgggaggccaaggccagtggattgcttgagcccaggagtttgagaccagcctggacaacgtggaaaaaccccatctctactaaaaatacaaaaacaacaaaacaaaaacaaaaaacacctcagctgggtgtggtggtgcaggcctgtaatctcagctactccagaggctgaggcatgagaatcccttgaaccacagatgcagaggttgcagtgaactgagatcatgccactgcactccatcctgggcaacagagtgagactcggtctcaagagggaaaataaggcatttttctcatttaaataataaatagtattccattatgtatatcaaccacattgtctttatttactcattagatgttgaactgtttattctgtattttggctattgtgaaacaagtgctgcaaacagaagtgcaaatgtttctttattcttattttgttttggatatatacccagtagtgcgattgctgtattacctggta

SEQ ID NO: 407056 - DNA, 723 bp, Homo sapiens
gtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaataga

SEQ ID NO: 407057 - DNA, 513 bp, Homo sapiens
gtggaagaaaaatagtgttaaaaagtgaaaaatttgtgacagataaaatagtatcccaaaagaccagaaaaaaacaaaaacaaaaacaaaaaaacctgactctagtgagatggtgtaagaacttgcaaagtaaaatgcacctggagcagtcaccgagaaatactgcagtgtctcctgtatgggtggttcatgagcacataagtgagcaggagtgggtggaagaatctcccaagtgattgaatggcctgacttgaaacatgagtcagacacacatttgttttttaatcagcactgccactccctgggtttgtcaccttgaaaatatttgtttacttattttgacctcacttttttagctgtaaattgcattatattagtagggcttgaaaggtaggaatttttttttttttttgaaacaagtttcactcttgctgcccaggctgcagaggttgtagtgagccgagaccgtgccactgcactccagcctgggtgacagagtgacactctgtctga

SEQ ID NO: 407058 - DNA, 784 bp, Homo sapiens
gagactccgtctcaaaaaaaatttatactgtacaaaaaccccacaagtgtgaaaaacatggcaaagcctttaagaagccctcaattcttaacagacataagataatttatactggagagaaactctacaaatcagaaagatgtgactacttttgacaacgcctcaaacttttctaaccataaaagtaattatactggtgagaaatcctagaaatctgaagagtgagataaagcctttaaatggttgtcacacttcattgtaggccaggagtggtggctcacacctgtaatcccagctctgggaggccaaggccagtggattgcttgagcccaggagtttgagaccagcctggacaacgtggaaaaaccccatctctactaaaaatacaaaaacaacaaaacaaaaacaaaaaacacctcagctgggtgtggtggtgcaggcctgtaatctcagctactccagaggctgaggcatgagaatcccttgaaccacagatgcagaggttgcagtgaactgagatcatgccactgcactccatcctgggcaacagagtgagactcggtctcaagagggaaaataaggcatttttctcatttaaataataaatagtattccattatgtatatcaaccacattgtctttatttactcattagatgttgaactgtttattctgtattttggctattgtgaaacaagtgctgcaaacagaagtgcaaatgtttctttattcttattttgttttggatatatacccagtagtgcgattgctgtattacctggta

SEQ ID NO: 407059 - DNA, 311 bp, Homo sapiens
  misc_feature (39)..(39): n is a, c, g, or t
gagacatgagatggtggatgaacccccaggatacatgtncaggatgtgcagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaataga

SEQ ID NO: 407060 - DNA, 350 bp, Homo sapiens
caccatgttgtgcaataaatctcttgaacttatttcttccatttgactataattatgtattatttcacaaacatgtttccagccttccatttcttataaataacttgcatctgatggtcaccattttactctctacatcaatgggattaagttttttggaatccatgtgtaagtgaaattatgagacactaatctttctgtgccttgcttatcccaactaatacaatgtcctccaacttcatccatgtgattgagaataatagtttttgttttttttttaaggccaggagtggtggctcacacctgtaatcccagctctgggaggccaaggccagtggattgcttgagcc

SEQ ID NO: 407061 - DNA, 455 bp, Homo sapiens
cagccaccttttagtttttttctggtcgtgggtttcagtgctgtctggggatgaactaagatatccaccgtggttatgtcagctaaagtgcctagtgaatatcagcttctggtttattttcttccataggacgacttgaaatatggagtgtatcctctcaaggaagcaagtggatgccctggggctgagaggaatcttctagtttactcttattttgaaaaggtaacctcttgagacattaaaattgtctacgcccaacccagctttcatttcttggggacacattgctggtcagccagtccgatgctggcactgatgggaaaacacagaaataatgtatgccccctggattgtcttagggggcagaaagataatgaaataaatatagtggaagaaaaatagtgttaaaaagtgaaaaatttgtgacagataaaatagtatcccaaaagaccaga

SEQ ID NO: 407062 - DNA, 1964 bp, Homo sapiens
  misc_feature (16)..(16): n is a, c, g, or t
aggggcccggattganccctccccgcccgggctcccgacgcgccgaggtctcggggaggcccggacgcgccggtcgcaggcccggccggcgagcggcgggcgggcggcggggagcgggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagcaggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccacccctgcagaggcctgaagctgggcctgggcaccccattcactcccgttctcatttacatctgttttcctgttgtatatatcacctttgttgacaataaattatttttttttattaaaa

SEQ ID NO: 407063 - DNA, 1896 bp, Homo sapiens
  misc_feature (16)..(16): n is a, c, g, or t
aggggcccggattganccctccccgcccgggctcccgacgcgccgaggtctcggggaggcccggacgcgccggtcgcaggcccggccggcgagcggcgggcgggcggcggggagcgggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagcaggcccaggggactccgccccctcgagcttcctgagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagggagccctcatttcaagtcctggggtaccctgtgcgcaaactccatctatctggagtgctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccacccctgcagaggcctgaagctgggcctgggcaccccattcactcccgttctcatttacatctgttttcctgttgtatatatcacctttgttgacaataaattatttttttttattaaaa

SEQ ID NO: 407064 - DNA, 1812 bp, Homo sapiens
  misc_feature (16)..(16): n is a, c, g, or t
aggggcccggattganccctccccgcccgggctcccgacgcgccgaggtctcggggaggcccggacgcgccggtcgcaggcccggccggcgagcggcgggcgggcggcggggagcgggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagcaggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctccatccttatttttgttttctttctttttgtttatttttgtcctttctattatctttctacctttttgtttatactttttattctctttttcttggtatctctccttctcctcttttgctaaattatcttt

SEQ ID NO: 407065 - DNA, 1461 bp, Homo sapiens
  misc_feature (16)..(16): n is a, c, g, or t
aggggcccggattganccctccccgcccgggctcccgacgcgccgaggtctcggggaggcccggacgcgccggtcgcaggcccggccggcgagcggcgggcgggcggcggggagcgggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagcaggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagggagccctcatttcaagtcctggggtaccctgtgcgcaaactccatctatctggagtggtatataggctggaggcagtaaatctttaaaaaccaggggcccccgtggcggttctttgcggagcagaggctctggacctgtggtttcagacgatctcacgaacccaaagcttggacagatttctcagaaacctgtgaggcttcgaccaaaatgtctctactttctgtgttgttatgtacgtattgaagttctctgaagactttatttaaataaagatcctgccacttta

SEQ ID NO: 407066 - DNA, 1066 bp, Homo sapiens
  misc_feature (16)..(16): n is a, c, g, or t
aggggcccggattganccctccccgcccgggctcccgacgcgccgaggtctcggggaggcccggacgcgccggtcgcaggcccggccggcgagcggcgggcgggcggcggggagcgggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcaggggacagagacccagagagagagggggacagagacccagagagagagggggacagagacccagagagagagggggacagagacccagagagagagggggacagagacccagagagagagggggacagagacccagagagagagggggacagagacccagagagagagggacacggagacagagggagacagagacaaagagacgcagagagaacgggaccccctcagagagaagataggtggggcggaggggacaaagagaccaagacagggatgggcggagggccagggttcagggcgggcgtcccggctccactctggagccccgagcatgcagccacctggtgcccgggccccgcacacgcgcaggt

SEQ ID NO: 407067 - DNA, 2182 bp, Homo sapiens
  misc_feature (16)..(16): n is a, c, g, or t
aggggcccggattganccctccccgcccgggctcccgacgcgccgaggtctcggggaggcccggacgcgccggtcgcaggcccggccggcgagcggcgggcgggcggcggggagcgggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagcaggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccagtttcagcttgagtcacattccagtcctggctccctgagaccgagtgtgctgcttggacttgagcgtgtcccgagtctcctggtcctctccggtggatccctgctctaaatggctgacctcttccactgtctaatgggtcttctgatttcattctcgaaagggagccctcatttcaagtcctggggtaccctgtgcgcaaactccatctatctggagtgctccccctccggggctccgcgggacactggatctccaggttatccgcgtgcggatggaggagcccccagcggtcagcctcctgcaagactggtccaggcacccccagggcaccaagcgtgtgggagcaggtgacacctcagactggcccacagttctgtcagaatccagcaccactgtggcagggaagccggaaaaagggaatggagtgtaaattcttgctttcctggggagggagggagggatgaggcagcgtcccccagtggcttataactcagagctgcctggctcacccacctggtggagagagtagaaacaggtgccagggcaggagggggctggggcagcatccactgttatttcggggcactggaaagtgtctgttcctggccaggcctgaggtcggcgagggtggctgaggctgttgtgcagtagggcactgggcctgtggagaacacctaccccagtccttcgctgacccccacctctgtttgtcccccatgacctcctcccaccctccccctgctccccaccattctcccttggcacagtgccttacacaagagtggtcataagggggtttgaactgagtcccactacctcgggggacacctctcctccccacttgttcaggcttctaaaccaggaggcctccattacctcttcctgtcccacccctgcagaggcctgaagctgggcctgggcaccccattcactcccgttctcatttacatctgttttcctgttgtatatatcacctttgttgacaataaattatttttttttattaaaa

SEQ ID NO: 407068 - DNA, 1949 bp, Homo sapiens
  misc_feature (16)..(16): n is a, c, g, or t
aggggcccggattganccctccccgcccgggctcccgacgcgccgaggtctcggggaggcccggacgcgccggtcgcaggcccggccggcgagcggcgggcgggcggcggggagcgggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagcaggcccaggggactccgccccctcgagcttcctgctgtccctgccacagagccaggaaataagaagccccgtggtcagagatggaaggaacccccaggggaagagccagtcagaaagaaaagaggcagacctatgaccaaaaacctggaccctgacccagagcccccatcgccagactcgcccacggagactttcgcagcaccagccgaggtccgacacttcactgacggcagcttccccgccggcttcgtcttgcagctcttctcccacacccagctcaggggcccagacagcaaggactcacccaaagacagggaagtggcagaaggaggccttccccgggcggagagcccctctccaggcctcaccccttcacgtagatcacagttttaactgtctcaagtttcagcttgagtcacattccagtcctggctccctgagaccgagtgtgctgcttggacttgagcgtgtcccgagtctcctggtcctctccggtggatccctgctctaaatggctgacctcttccactgtctaatgggtcttctgatttcattctcgaaagggagccctcatttcaagtcctggggtaccctgtgcgcaaactccatctatctggagtggtgagtagatgagaagagaatccctgagattctaggtttctttggggtgagtgggcaaagtctgagaggaaggggcttcagcaggctgcttgagtgatctgagggggcggaggcaattgtagggtgttgtcagcagtggcagccttcgtggaggttggagatgcctgggaaaccatagaggatacctcactggtacacaagtgttcctggagcctgtgcccgagggaggcaccctgggagatggcatgagtgagacagcctttgtcccccaaaattctgtgtccaggtatataggctggaggcagtaaatctttaaaaaccaggggcccccgtggcggttctttgcggagcagaggctctggacctgtggtttcagacgatctcacgaacccaaagcttggacagatttctcagaaacctgtgaggcttcgaccaaaatgtctctactttctgtgttgttatgtacgtattgaagttctctgaagactttatttaaataaagatcctgccacttta

SEQ ID NO: 407069 - DNA, 1075 bp, Homo sapiens
  misc_feature (16)..(16): n is a, c, g, or t
aggggcccggattganccctccccgcccgggctcccgacgcgccgaggtctcggggaggcccggacgcgccggtcgcaggcccggccggcgagcggcgggcgggcggcggggagcgggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagcaggcccaggggactccgccccctcgagcttcctgagcccccatcgccagactcgcccacggagactttcgcagcaccagccgaggtccgacacttcactgacggcagcttccccgccggcttcgtcttgcagctcttctcccacaccctgcagaggcctgaagctgggcctgggcaccccattcactcccgttctcatttacatctgttttcctgttgtatatatcacctttgttgacaataaattatttttttttattaaaa

SEQ ID NO: 407070 - DNA, 202 bp, Homo sapiens
ttgacatattcttagaaagcattagttttgtgttttgcagaaatttattctatgcagaattttcatgaatttgttcctatgttttcctttggtgctccttagcataatatggtagcagacagccttgggagttaaagttatattttacttttgtaatgtgcaagtgtcactaatatttgaataaagtagatgtgatgcttta

SEQ ID NO: 407071 - DNA, 894 bp, Homo sapiens
gtgaagacctagccgtgcctggagtaaattaagccagcagcaaataatcccaaaggaggtaaacatctaaaagaaaggaatgaaaacaggttttatttataaatgcctcactgttggaacctgcatgaatgaaagctgaatctcaaagatcagacacgttggacttggaataatgtccatgttatgattccaatctgtgcctaaatctgaaccactcagttcttcatgcttgttggaatcctcctaaaattggaatttcctgggagatatccagtactttttgggctgtaaacagcaaaacaaacagcctttcttgtaatatgctacgtctagtgctaactgaattcaagaagtttatgagtgtggggaaagtaacttgatgtctttgcaaacttacaaatttgcttcagtttaaattttgaccaaaaattcatctcaggaatatgttttggaataattctttgctattagttataaatgtgacaaatatcgtttaaacaataaaatgttattttatacaacaaattatggcaacaaattccttgtagtgatagattttttaaaatctttaaatcatagatagggatttattatgctccatgtcaattatatgcatgtttgtgtgtatatgtgtgtatatgtgtgtgtatatatatttcacttaatctctgagaacagtctgaatttttatgtttctctattggatataattgaaaaacataagacaaagaaatcacttattagtacgttgatagaataaacgtgcttgatgccaaatatagacacacaaaatacacttaattcttctgtaagaactcttaaccatctatgagaacatcttatcaaattgatttccccctttctccttagtaaaaaaatcctgacgtttttagg

SEQ ID NO: 407072 - DNA, 914 bp, Homo sapiens
atcttcacatcaccagtatgatggaattgaagcccaagattggtaatgttatgccagcagcaaataatcccaaaggaggtaaacatctaaaagaaaggaatgaaaacaggttttatttataaatgcctcactgttggaacctgcatgaatgaaagctgaatctcaaagatcagacacgttggacttggaataatgtccatgttatgattccaatctgtgcctaaatctgaaccactcagttcttcatgcttgttggaatcctcctaaaattggaatttcctgggagatatccagtactttttgggctgtaaacagcaaaacaaacagcctttcttgtaatatgctacgtctagtgctaactgaattcaagaagtttatgagtgtggggaaagtaacttgatgtctttgcaaacttacaaatttgcttcagtttaaattttgaccaaaaattcatctcaggaatatgttttggaataattctttgctattagttataaatgtgacaaatatcgtttaaacaataaaatgttattttatacaacaaattatggcaacaaattccttgtagtgatagattttttaaaatctttaaatcatagatagggatttattatgctccatgtcaattatatgcatgtttgtgtgtatatgtgtgtatatgtgtgtgtatatatatttcacttaatctctgagaacagtctgaatttttatgtttctctattggatataattgaaaaacataagacaaagaaatcacttattagtacgttgatagaataaacgtgcttgatgccaaatatagacacacaaaatacacttaattcttctgtaagaactcttaaccatctatgagaacatcttatcaaattgatttccccctttctccttagtaaaaaaatcctgacgtttttagg

SEQ ID NO: 407073 - DNA, 914 bp, Homo sapiens
aggatttgcagaaagagccaacaactcctacagatgatgacagttctcattctccagcagcaaataatcccaaaggaggtaaacatctaaaagaaaggaatgaaaacaggttttatttataaatgcctcactgttggaacctgcatgaatgaaagctgaatctcaaagatcagacacgttggacttggaataatgtccatgttatgattccaatctgtgcctaaatctgaaccactcagttcttcatgcttgttggaatcctcctaaaattggaatttcctgggagatatccagtactttttgggctgtaaacagcaaaacaaacagcctttcttgtaatatgctacgtctagtgctaactgaattcaagaagtttatgagtgtggggaaagtaacttgatgtctttgcaaacttacaaatttgcttcagtttaaattttgaccaaaaattcatctcaggaatatgttttggaataattctttgctattagttataaatgtgacaaatatcgtttaaacaataaaatgttattttatacaacaaattatggcaacaaattccttgtagtgatagattttttaaaatctttaaatcatagatagggatttattatgctccatgtcaattatatgcatgtttgtgtgtatatgtgtgtatatgtgtgtgtatatatatttcacttaatctctgagaacagtctgaatttttatgtttctctattggatataattgaaaaacataagacaaagaaatcacttattagtacgttgatagaataaacgtgcttgatgccaaatatagacacacaaaatacacttaattcttctgtaagaactcttaaccatctatgagaacatcttatcaaattgatttccccctttctccttagtaaaaaaatcctgacgtttttagg

SEQ ID NO: 407074 - DNA, 897 bp, Homo sapiens
  misc_feature (37)..(37): n is a, c, g, or t
  misc_feature (41)..(41): n is a, c, g, or t
cgttgaacaatgagataataagataagaaattgctcnacgnaacgcaaatatcccttggaggtaaacatctaaaagaaaggaatgaaaacaggttttatttataaatgcctcactgttggaacctgcatgaatgaaagctgaatctcaaagatcagacacgttggacttggaataatgtccatgttatgattccaatctgtgcctaaatctgaaccactcagttcttcatgcttgttggaatcctcctaaaattggaatttcctgggagatatccagtactttttgggctgtaaacagcaaaacaaacagcctttcttgtaatatgctacgtctagtgctaactgaattcaagaagtttatgagtgtggggaaagtaacttgatgtctttgcaaacttacaaatttgcttcagtttaaattttgaccaaaaattcatctcaggaatatgttttggaataattctttgctattagttataaatgtgacaaatatcgtttaaacaataaaatgttattttatacaacaaattatggcaacaaattccttgtagtgatagattttttaaaatctttaaatcatagatagggatttattatgctccatgtcaattatatgcatgtttgtgtgtatatgtgtgtatatgtgtgtgtatatatatttcacttaatctctgagaacagtctgaatttttatgtttctctattggatataattgaaaaacataagacaaagaaatcacttattagtacgttgatagaataaacgtgcttgatgccaaatatagacacacaaaatacacttaattcttctgtaagaactcttaaccatctatgagaacatcttatcaaattgatttccccctttctccttagtaaaaaaatcctgacgtttttagg

SEQ ID NO: 407075 - DNA, 1217 bp, Homo sapiens
gctattaacactactcaaattttaaactctggatacaaatgactttgataaaagtccttaaaactattttgacattaaattatttggtattccacaaactacagtagctcatacctatgcaaatatttagaagaaggagaagtaccctttttctttgttttcatgatctccaaaatctagtttttagtctataaacatccatccctactccacattttcatgtaaagattatgtagaagttgggcaacagtgtagtcacaggatgtcatataagtgtgaataagctgagattattgcatttgtatttagcatattatacaattaaaatgtattttattaaacctgaagcaagttttctttcatgtctagacatcagtgtgttacagagtttaattcattaagctctgtatttgaatataacaccttgtaaaaatgtttgaaacttatcctcttgtatgttaaatatttaaatatttgtatatggccctattcagcctgtgctttataaatcacaaaagagctgggttttatatgtttgttttttatttctaagctctctgcgaaaaagttacaaattgtctccttaagatattttttctttgtaatttttttatatcatgttgtgatttccataaatatgtgcagttactcttgataatacttgtcttattcatttcaggttgctataacaaagtaccatagactgggtggcttataaacgacagaaatttatttcttacagctctggagctggaagtctgagatcagattaccagcatggttgggttctggtgagagccgtcttggttgcagactgccatcttcttgtatcctcacatggccaaaagaggacaagagaactctctggagtctgtttgataagagcatgaatcccattacatcttcacatggctcctcccaaagaccccacctcctaatatcatcacatgtcatcacatagggggttagaatttcaacatagaaattttgggagaacacaaacattcagtcagttgcaatacttaaggcaaattcatcttgcttataactctggtgcatgtgcattaaaatactattgcattgtaactgagtttgtacctattttctgctttctgattatttcctttgttcatgaaaataaatgactggtattacaaggtcacctaaataaataggtttgtgtacgtctgcgactagagagaaatactacagtgatt

SEQ ID NO: 407076 - DNA, 1074 bp, Homo sapiens
tcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgc

SEQ ID NO: 407077 - DNA, 1133 bp, Homo sapiens
tcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagatacagttgtcttggaagcctgttattgataaagttgctgcagcctcacatccttcaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgc

SEQ ID NO: 407078 - DNA, 1452 bp, Homo sapiens
tcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaacttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaatataatgtgccaactag

SEQ ID NO: 407079 - DNA, 1173 bp, Homo sapiens
tcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagaaaaactgcctgctcttctaaattgtgtgtcccaaaatatttcattaacaagtatcaagtgataatccatggaaaagtgatggaaagtcacaatacaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgc

SEQ ID NO: 407080 - DNA, 1589 bp, Homo sapiens
tcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcagctctggagctggaagtctgagatcagattaccagcatggttgggttctggtgagagccgtcttggttgcagactgccatcttcttgtatcctcacatggccaaaagaggacaagagaactctctggagtctgtttgataagagcatgaatcccattacatcttcacatggctcctcccaaagaccccacctcctaatatcatcacatgtcatcacatagggggttagaatttcaacatagaaattttgggagaacacaaacattcagtcagttgcaatacttaaggcaaattcatcttgcttataactctggtgcatgtgcattaaaatactattgcattgtaactgagtttgtacctattttctgctttctgattatttcctttgttcatgaaaataaatgactggtattacaaggtcacctaaataaataggtttgtgtacgtctgcgactagagagaaatactacagtgatt

SEQ ID NO: 407081 - DNA, 565 bp, Homo sapiens
tcacgacgctgcacttactactcatataaataaaaaatatgtcgtacatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaacttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaatataatgtgccaactag

SEQ ID NO: 407082 - DNA, 233 bp, Homo sapiens
acaacaccaaaaattctaatgatatatggacataggacataaggagataatacttaggttaggaaatgcccatggataataaacatggaaaaatttataagtaaagctttaatttttctttttctttacattacacagagaaggccaagctattatttttgtcattgatagtagtgatagattaagaatggttgtggccaaagaagaactcgatactcttctgaatcatccag

SEQ ID NO: 407083 - DNA, 744 bp, Homo sapiens
caaggcctatttgaatttttgttgttgttgtttaaatgaagaggaaacaatacttaacctgaaaattttacatgatacagttcaatttctgaaaatgctaagtgcatgactatattggaaagttgtttatactgataaaaattctgcttaccagactttccagtgccagagatgaacaacctgaatcgctgatcaatacgtagtttacattctgtattggcttctttccttcctctatgtgattcatttaagaaaaagtttattgtttacacaagctgtgtgtgtttggcctgagagatgctgtacgggattgaacacatagctcatccattgggtctcttgttgtcctcggcgggatctgatgtgtccttgttgaggctgctcattggtgtctcctgtcccactggctccagccttcctgacttactaaagaactcgccacagtttggaaatgtttgttttacatgtgacctgtgtaacatctctccagctggggagtttcagtacttgcctttaataatccatagataggcgcttgtaaagccagctacttgggagagtgaggaaggagaatcacttgaacctgggaggtggagcttgcggtgagctgagatcgtgccactgcattccagtctgggtgacagagagagactccgtttcaggaaaaaaaaaaaaatccacacataatgtttcttgctcactttcacaagaggtggctgggcgaggagctgtccccattcctcc

SEQ ID NO: 407084 - DNA, 468 bp, Homo sapiens
cgagccaggcggtctgccctgcagcagctgcacgggggcgggaaccggccctcagccccatccccggtggctgcagagggcccctggctagaggtctcgagctctggcagaggaggagccgggagggggcagggtctggcgggctctcaggccaggggcacccgcgatccagaggccgcccaggccatgctccaccacctgggcgcccagctacaggcgccgggcaactcccaagctggctggcgcgcccagcctcgcagaaccggggctagatgtcgccgtggctgcggccaagccaggcggtctgcccggcggcggctgcaccggggcaggaaccgaccctcagccccatccccgcggacggtccctggagcggccccgatctctcttcggagaagaggggcgggagtcacggccaggcgggaagggatgcgcgcctgagattccggaacgtcccgcgccagccca

SEQ ID NO: 407085 - DNA, 412 bp, Homo sapiens
cgaccttcccccacaaggtgagcacaggcgggagccgcagctcggcccccagagctcctgtgtcagtgtttcagtaactgtcggaaacgtgctagggcgtcataaggacaagtcgactgtaaataatgaaacccgagtatgttacggttccttttgttccaaatgttttttagcaagagagaaagtccatgagcgtgccccttccagaggcaggcctttctctatctggtgctgtgctctcactggttctcacctcccccagctgcttttgcccctggcctgtggcccacacagagaaggcccctttctttctagttctgcctatcctcagggcaggggacttctggacaagtcctgcaagccaggctgtgggcctagcagaggcagtgtggagtgggggtggccaggtcag

SEQ ID NO: 407086 - DNA, 199 bp, Homo sapiens
cctactgaagcctcggtttccttatccgaaacctggggtgtggtggggtcacctccattcatgcttgtgaaagtcctttgtaaatgaaatgtacaggacaagcttaaggggggcccaaggaggggaacgcatcttacaccttgcaaaggccaccaataccaagcccaagtgcccaggctttatttttcagatggggtga

SEQ ID NO: 407087 - DNA, 227 bp, Homo sapiens
tgtcatctcaactccttcccaggggctcaggctaacccgaatactgtgggcttcactgcgttttgtgccacctgggctgtactgtatttatggcccacgtgttcacattcatcaggcgtctctctcattacttggctgacctgcccaccagtcagtctcctgggcttgttggtgacgtattccggtggggcacagacactgtggcctgttccctctgtgatatgtta

SEQ ID NO: 407088 - DNA, 263 bp, Homo sapiens
ccaggtgtggtgatgcatgccggtagtgccagcctactcagaggctgaggcaggaggattgcttgagcccaggagttggaggctgcagtgagctatgatcgtgccactgcactccagcctgggcaacagagcaagaccctgttttaaaaaattaaacaaaaaaaacccctcagctcctcaagccacatttcaagtgctcaagaaccacaggtgctagaacctagagtactacacagtatggagtccttctagaagctcctcta

SEQ ID NO: 407089 - DNA, 176 bp, Homo sapiens
cagcagagtgaaaccctgtctgtctacatacacacacatgcacgcatgtacaattagccgggtgtggtgggggcatgcctgtagtcccagctacttgggaggctgaggcaggaggattgcttgcaactaagagttcgaggctacagtgagctataatcatgccactgcattccagc

SEQ ID NO: 407090 - DNA, 93 bp, Homo sapiens
ggggctgatgggacagcaggaggggcaggaaggaagggactcaaggtctaggcagagggggcagcctgcagagatgggaggtggcacccaaga

SEQ ID NO: 407091 - DNA, 216 bp, Homo sapiens
gggcggaggggggactgtgttgcttaagaaaaaaatctcagtatcagtagactagtgggacaaaagccaggctgccctgggttgaacagtgactggaaggtgaagaaatggaggcagtgactgcagactccctactcaagaaacctgggtaacaggggaagaagaaacatagtgtctaggtcagtaggggctctttgaactattgtgtgtggctgg

SEQ ID NO: 407092 - DNA, 269 bp, Homo sapiens
ggataaactcctgaacctaagttcctgtctgagtgtcttttctggggggacctgaactaagaagccattaaaggtaaagaaaacagcattccatgggaatcagcctggaaaagtgtacagagtggagtgatgggaaacgggctggtgtcaaggaaaccaactcaagtactttggcaaaagcccccccccagggtaagggtccgagggcctgaactgcagctgtgatgagagaatgcagaagggcagacgtgggacgtgagaaggccagc

SEQ ID NO: 407093 - DNA, 179 bp, Homo sapiens
ggttgcagtaagctgagatcgcaccactgcactccagcctgggcaacagagcaagagaccatctcaaaaaaataaaaacacgagtgaaatagatgagaaaacatccaggtatattccatgtgagagggtaagcattagatcatgaaactgattttggttgtatcttatgcatgcacatg

SEQ ID NO: 407094 - DNA, 262 bp, Homo sapiens
ggagcagcagggctggggccaagtccctgggtctagaaagccactatgaatgaacgctgcttgcacccattataggtctaagcaccaatccaggctcaaccgctcactccaggaggatgggaagcctttgttttggttcctgtgccaactctggcttctctggctgccccattcaatctgacagaacatgttgacggagataaggttattactggctcccgcaaggccctaccatgtgaggtggtttccagtggcctttccc

SEQ ID NO: 407095 - DNA, 298 bp, Homo sapiens
actagctgtgtgactctgggtgagtcactttaatccaccaagcttctgtgtcctgcgggttaatagtgtctgtggggggccagcctggcattggacaggcattcgagaagtgctaattattgtttttgaagcagctttattgacatagaagtcacatatcatacaattccccctttcaaaatgcacatttcaatggcttttaggatactcacagaggtgtgcaaccatcatcacggtcaattttagaacattttcatcactacaaagagaaactacaaacaagagctgggtgtagtgc

SEQ ID NO: 407096 - DNA, 276 bp, Homo sapiens
ggggccacagttcatggggcttttcttcccagaggaaaatcagggggagggtgagtgcccagctttgttctgctaaccagctgcagctttttcatctgtttctcctgggttttcaatgggtctctcctgttatttacatttcatttctcctgtccttagcaactagaagctgccctttcaagttttacttagaaaaaggcccttaattggttctgcaattggaagggcgatcctgaacaggagttattttgccttaagatagaaaataaggtcggg

SEQ ID NO: 407097 - DNA, 303 bp, Homo sapiens
ccgactggtctcgcactcctgagctcaagtgatccttctgccttggcctcccaaagtgctcggattataggagtgagtcactgcgcccagcccacaccacttcttaattcaagctacaggtccccctttgcctttggattacatctgctgtgtttcttgtcttatcaagcttaaccctcctgtccttgcttcttgaagtcatccccctattgccgggcagttggccattccccagtccaagcacagcacccccttgcaggccatccttagcctcccaagtacccgggattacaggtgcacacc

SEQ ID NO: 407098 - DNA, 282 bp, Homo sapiens
attgcagtcacctggaatcagaaggctcttgctataatattgcttaagagagataccaggtgttagtgttatcactcttgttaggaagacactattatccaaatggacagtcctagccatgttcctcctcaggtggagctaacgtgatgggctccttggcccttatgctcacctgtgcatgcccgggaaggatgggcatgaagagggatcctggctgtcctgaatcacaagtgttttaacctgccccaatctggacaggctgccctcccgtcctgggataca

SEQ ID NO: 407099 - DNA, 295 bp, Homo sapiens
ttaactgatgtggtggagggtgcctgtaatcccagctactcaggaggctgaggcaggagaattgcttgaacccaggaggtggaagttgcagtgagcttagattgcgccactgcactccagcctggaccgcagaacaagactctgtctcaaaaacaaaacaaaacaaatgcaaagggccttctggtcaacccacagtgggatggggaggaggaggagacacggggagggagaaggtggaaggtgccctggtgggccttggcccagcctcttcacagactgaaagagtcagccctgc

SEQ ID NO: 407100 - DNA, 230 bp, Homo sapiens
gatctcctgacctcatgatccacccgcctcagcctcccaaagtgctgggattacagttgcgagccaccgcgcccgacctatttattcttattaagcggttaataccacttttggaaatgtatcgcagagaagtaacccaaaagaagatagtccttacaaaattatttatagctgcagtgcacaacagtgaaaagaggggaagcaacccaaatgcacagtggtagagagtc

SEQ ID NO: 407101 - DNA, 198 bp, Homo sapiens
ctccagcaggaaggcaggtggcaaaagtgctaagtaaatagcatagaaggtaggttagaaggtgacaggtcctgttggaaaaagaaaaggctggctggctgcagtggcccatgcctgcattctcagcactttgggaggccgaggcgagcggatcaggaggtcaggagatcaagacaatcctggctaacacggtgaaac

SEQ ID NO: 407102 - DNA, 287 bp, Homo sapiens
ctctgcttcatcctggtgcaatgcccatttcccaatactggattcataaatgtctctcaccctttgtgctcactctcctgggcttcctttggatctggcaagtgagtgccgtaattctctggtggcttctgaaccatagagttacctggcgacagatgggctattcagttttctcagcttttcttcttcattcttgccagttactcaactcccataaaacatttcagcctgcagaccctgccaatttttacatccccctctgctctccaacttagttaaggcacttc

SEQ ID NO: 407103 - DNA, 260 bp, Homo sapiens
ccagacgtgagccaccgtgcccggccagcagagtcgtttattgccattgtcatgtattatgtactaatcgtatgtgctagacttccatgggactggcagtgcagtgggtttgtttacaccagcatcaccacactcacgaggcacgcgttgcccttggactgttacagtgacgggagttttcagctatgttgtgatcttatggaccgccatcatatgtggtctgttgttgaccgtatgtatgaggtacatgactgtacttt

SEQ ID NO: 407104 - DNA, 294 bp, Homo sapiens
ggaccattcgcatccatttgcagagctggtaaaagtgctaactatagccaatgccgattgaggcttcgttccaggcaacaaacacctcagcaggttcacctggtgattaaacccacctatgctgggggcaagaacctgatgccctacttacactggggacaggtgattgcttgaattgaggaagagaatagtcaagattcacctcaaagtcgatggcatttgccagggttctgagtttcagcaacaaacagcactcatgtttgtcagaatgagcctctgagccacctccccatg

SEQ ID NO: 407105 - DNA, 206 bp, Homo sapiens
cagggtctcccttcaaaaatgaaagattacaaaaaaagatcatcatgtgtttatttcttttgttgtgagacagaagtttcactattgttgtccaggctggagtcaatggcgtgatctcggctcactgcaacctccgcctcccaggctcaagagattctcctgcctcagcctcccaagcagctgggactacagacgcatgccacttt

SEQ ID NO: 407106 - DNA, 292 bp, Homo sapiens
ggcaccagcagattcagtgtctggtgtgggcccttttcagggttcatagagggtgccttcttgccatgtatgctcatggcagaagaggtaagggatctctctggggtcccttttataaaggcactaatctcatttatagacactccaccctcgcgacctaatcatctccccaaaggcctccatttccagctaccatcaccttgggggtcaggtttcaacacaggaatctgggggagacacaaacatcaagaccatagcaagggggactagaaaggcttcaggagacaaaaag

SEQ ID NO: 407107 - DNA, 275 bp, Homo sapiens
aatttttagctgataatttatcgtatatgatttgtctcacatagagatatatttatagcacatttggtaaataaatatcttttctattaaaaaggccaaagcacatccagtgataacttcttaacttaagcacatccagtgatacttcttaactaaaggttgcctgtggaaaatattggttcttctggggactaaaaagggaagtagatagaaattctgatatcttaggtcattggaaatagggaagtgggagtgagtaaatgtagggatttcag

SEQ ID NO: 407108 - DNA, 301 bp, Homo sapiens
ggaactctccaaagtctcagaaaaagtctttgatttataaagtacatttaaattcacttccattgaaacgtacacacacccagggtctgccagagaggacaagggaggacactgacatttccaaatcaacctgacaccaccaggatataggagacccccaaggacctccacgggacctggggatttggggcgtgggtgagaagtgggcattaggaaggattcaactctttgcacttcttctgacagcaaggagggaggtgcagggaatgtttctatctcctgcttgcatccttaggaatgg

SEQ ID NO: 407109 - DNA, 313 bp, Homo sapiens
attagcttgtccaactgcctagctaagtccatcaatttcctgagctcagggagtacaactacttctactgtcaattcctcatcaattcctcatctgcttttggccccacacattttttagaccaaagctccggctgctggagcattatcttgaagtgactgtagacccaataccaggattctgccctgtctgtgtactgccagatccaacccatgtgtcttggggtggctaaatctgacaaaggccctgagtgtctggggacacctgtgatctcctgcaaggctgaggctaatgccacgcttttgcagctctt

SEQ ID NO: 407110 - DNA, 330 bp, Homo sapiens
gggaattagacagcagaaagaagaaaagggagctcagggcaggagggataggctgagcaaaagcacggaggtgtgagcaaggctgggaggtgtaggcagggacagggtgagagctaaggcacttggatggtatcttgcaggagatggggagctagtgcatgtatttagatggggagtggagctgtcaggtttatattttagagcactggcctgagcagcagtgcgcatggattagaggggaccagacctttgtaagaagagcagtcaagatgtgtatcagttagaaagccttagactgtaagtagcagcaaatccaacccaaaaaggctt

SEQ ID NO: 407111 - DNA, 1079 bp, Homo sapiens
atattagggaggaagcctgaagtagggagatgtaaggagccatcaaaggcagaatgaaacttaggcagatttcaagtgattttcattaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacgctatattaccaccaagaggtcaaataaataccaaagaatgtattttcgaatttaacaatgaggaacttaatcatacaggcagaagtaattccagagcactggagacagaagccagattgccatatgggttaaagagtgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacaatggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatgtagggt

SEQ ID NO: 407112 - DNA, 3226 bp, Homo sapiens
cgcgcatgcgcctctgtgcgtttgtcccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtgctggaagccttatatcgtctgcaatggacttcaacagatgggctgggggttctcataatatcacctacgagagaactggcctatcagacctttgaggttctccgaaaagtaggaaagaatcatgacttctcagctggtctcatcattggtggaaaggatctaaaacacgaagctgagaggatcaacaacataaatatactcgtgtgcacaccaggtcggcttcttcaacacatggatgaaacagtatcttttcatgctaccgacctccaaatgttagttcttgatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatatagcacccctgccactttggaacagaactacatagtctgtgagctgcagcaaaaaataagtgtgctgtattcctttttgagaagccatctgaagaagaagagcattgtatttttttccagttgcaaagaggtccagtatctgtaccgagtgttttgccggctacgtcctggtgtttctatccttgcactccatggtcgacagcagcaaatgagaagaatggaagtctataatgagtttgtccgtaagagagctgcagtactctttgctactgatattgcagccaggggtctggatttcccggccgtgaattgggttcttcagtttgattgtcctgaggatgccaacacatatattcacagagcaggtagaactgccaggtacaaagaggatggtgaagctttgctaattttgctaccctcagaaaaagctatggtgcagcagcttcttcagaagaaagtacctgtgaaggaaatcaaaatcaatccagaaaaacttatagatgtccagaaaaaattggaatctattttagctcaagatcaagatttaaaagaaagagctcaaaggtgtttcgtctcctatgtacgatctgtatatctgatgaaggataaagaagtatttgatgtgagcaagttacctatacctgaatatgccctgtctcttggtcttgctgtggcaccacgcgtaagatttcttcagaaaatgcagaaacaacccaccaaagaattggtaaggagccaagccgataaagtaattgagccaagggctccctccctcaccaatgacgaagtggaagaatttagagcctacttcaatgagaaaatgtccatccttcaaaaaggtggaaaaagactcgaagggacagagcacagacaggataatgatactggtaatgaagaacaggaagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaagatgctgatttcttgaaggtgaagcggcataatgtgtttggattggaccttaaagacgagaaaacattacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctat

SEQ ID NO: 407113 - DNA, 3267 bp, Homo sapiens
cgcgcatgcgcctctgtgcgtttgtcccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtgctggaagccttatatcgtctgcaatggacttcaacagatgggctgggggttctcataatatcacctacgagagaactggcctatcagacctttgaggttctccgaaaagtaggaaagaatcatgacttctcagctggtctcatcattggtggaaaggatctaaaacacgaagctgagaggatcaacaacataaatatactcgtgtgcacaccaggtcggcttcttcaacacatggatgaaacagtatcttttcatgctaccgacctccaaatgttagttcttgatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatatagcacccctgccactttggaacagaactacatagtctgtgagctgcagcaaaaaataagtgtgctgtattcctttttgagaagccatctgaagaagaagagcattgtatttttttccagttgcaaagaggtccagtatctgtaccgagtgttttgccggctacgtcctggtgtttctatccttgcactccatggtcgacagcagcaaatgagaagaatggaagtctataatgagtttgtccgtaagagagctgcagtactctttgctactgatattgcagccaggggtctggatttcccggccgtgaattgggttcttcagtttgattgtcctgaggatgccaacacatatattcacagagcaggtagaactgccaggtacaaagaggatggtgaagctttgctaattttgctaccctcagaaaaagctatggtgcagcagcttcttcagaagaaagtacctgtgaaggaaatcaaaatcaatccagaaaaacttatagatgtccagaaaaaattggaatctattttagctcaagatcaagatttaaaagaaagagctcaaaggtgtttcgtctcctatgtacgatctgtatatctgatgaaggataaagaagtatttgatgtgagcaagttacctatacctgaatatgccctgtctcttggtcttgctgtggcaccacgcgtaagatttcttcagaaaatgcagaaacaacccaccaaagaattggtaaggagccaagccgataaagtaattgagccaagggctccctccctcaccaatgacgaagtggaagaatttagagcctacttcaatgagaaaatgtccatccttcaaaaaggtggaaaaagactcgaagggacagagcacagacaggataatgatactggtaatgaagaacaggaagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaagatgctgatttcttgaaggtgaagcggcataatgtgtttggattggaccttaaagacgagaaaacattacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagtaaaaaaaaaaatcggcctccttgggctcagg

SEQ ID NO: 407114 - DNA, 1723 bp, Homo sapiens
ctcaacgctttatattcctgttcttcattacaagttacctatacctgaatatgccctgtctcttggtcttgctgtggcaccacgcgtaagatttcttcagaaaatgcagaaacaacccaccaaagaattggtaaggagccaagccgataaagtaattgagccaagggctccctccctcaccaatgacgaagtggaagaatttagagcctacttcaatgagaaaatgtccatccttcaaaaaggtggaaaaagactcgaagggacagagcacagacaggataatgatactggtaatgaagaacaggaagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaagatgctgatttcttgaaggtgaagcggcataatgtgtttggattggaccttaaagacgagaaaacattacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagtaaaaaaaaaaatcggcctccttgggctcagg

SEQ ID NO: 407115 - DNA, 1291 bp, Homo sapiens
cagttttgagaagtatattgccagagttggattgttaatataaagcaaccattttcctaatcatctgtgttttttgtatgttctcacacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagtaaaaaaaaaaatcggcctccttgggctcagg

SEQ ID NO: 407116 - DNA, 1007 bp, Homo sapiens
cgcgcatgcgcctctgtgcgtttgtcccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtgctggaagccttatatcgtctgcaatggacttcaacagatgggctgggggttctcataatatcacctacgagagaactggcctatcagacctttgaggttctccgaaaagtaggaaagaatcatgacttctcagctggtctcatcattggtggaaaggatctaaaacacgaagctgagaggatcaacaacataaatatactcgtgtgcacaccaggtcggcttcttcaacacatggatgaaacagtatcttttcatgctaccgacctccaaatgttagttcttgatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatataggaagagcattaagaagttggttttgaagaaccttaataatagcaatctcttttctcc

SEQ ID NO: 407117 - DNA, 313 bp, Homo sapiens
acatattaaatggagaaatccagaaataaacggtttataagttttaaattgcatgctgttctgtgtattgtgataaagtcttgccctatcccacctcaccctgcccagggtgtgaatcagccctttgcctagtgtgtccatgctgcacagttacgtatgtataggaaaaaatgtatactaggattcagtactgtctgtggtttcaggcatccactgggggccttgaaatgcatctccctcaggtaaggagggaagtactgtaatatgttgtgctgatcaaaagttgaaaactcaaccagtatggtgacagccc

SEQ ID NO: 407118 - DNA, 366 bp, Homo sapiens
agaaacaaaaagcaaaccccaaacctgatgtccttctttagcccactgtgatagtatcaccaccacaaaattgccactgcttattggcacaacaaataatggctagtattaatccattcatacacagagctggatatagataaagtataaataagaaaaaatgtgacaactatgtgtcagctagacattttctttaattaccatccatttcatttcacaaccctagatgtatacaagaagatcaatagcttcaaaagaaaaagcattttggaaggggattattttggttattcctgtgccccaaagggtggtctgttaaacatttatattttgtgaaataaatctcttatgaaaccccattagata

SEQ ID NO: 407119 - DNA, 433 bp, Homo sapiens
attcacttttttcgaaggagacagttggcatgttaaaaggtgtctacttagaaaacccagggtttaacttgtttagtacaaaagtgtttgtatgtgtattttttatttcccatgaaggagggaaggaagtaaatctaaccttgttcctctcagagaagaacactgaaactatattaacatgaagtagaaacatgataattgatatgttatatttttcagccactttcttttaaaaagacagaacaagtatttgttttccgagttaacagatcagaataggcagtttgtctttttatgaacaggaaaaacgaggcttgtctaccgctaggcagaaaacagaaaagaaggagtagtccttgctgtcttggttcctatcaggcaagtagaccaggttgcttttcaccctcgagtaaatagaatcacgtatctgtgg

SEQ ID NO: 407120 - DNA, 441 bp, Homo sapiens
tcattgggttgagtcagaacttctagattatcatgctccagagtcaaagctgcatagaaggggcatccaagaggcagaagtgaaggggttccttttgagctctgccatttccacatggaatttcttttcatttttccgagtacttgctgcttcccaaatctgggaaggatgtatccttctgtggccctgctttgcatcgtttcccacttcttcgtggtggattttggccctgggattggcccatcccttccttaccatctctttctcttaaagaactatgcaagagtttcctgttctgggtgagggttggaaaggagccctctttccctgccagctcagagaccctgtgagaggctgcaggagaaggattcctgtgtggtctcttctgtgtattcatctaaacagatttgcctttcccaccccatcacctcttgctcttct

SEQ ID NO: 407121 - DNA, 239 bp, Homo sapiens
aagatttttcaccatgacttacttgtggaaatcataaaggatgctgtttgttaccttttataatatattttctgtggacctcagctggtctgtttggaaaagaatttatacacatgcatatacatatatgacatatatgttctatacatgtatatatataagaggaaatagttatggctagtcttgaggttttggagaatgagttcatatttctatttgttgaaaacatattcaaggac

SEQ ID NO: 407122 - DNA, 399 bp, Homo sapiens
ttatattaactattgacagtttatacccttttggtaaagatcagatgtgagaataatctgccttggcaggttaaaacaaaacacttttattttgacacttaactttccagtttatttttatgggtagttctggggtggaaaataatatttacaaaataataaaagccatgatttggagacctgacccaagaagcttcaacatccttaggttgcttgcctgtgccactgtgccgtgacacattccctactgaacataggctagtgtgggattgctccacccagaggcccttccccagagcagggaggacatggagtgtttgtgaaggtttttctctccttaacaagtaggttagttttcaacagtttaagtactggagtaggtgctgactgttaatatac

SEQ ID NO: 407123 - DNA, 426 bp, Homo sapiens
aaaaaagtgtaaaatatatttgccaaattgtaagaataattttaatgcaaacacttgtgtggctgccacctattcaagaaacagaatcatgccaatctacatgtgcctcctctgtccagtttaggtcccaacggagtctaaactagaaatattttctagaagctcaagtggaatattgactttctctgctctttcaaatcatactcccactaaaagtttttactgagctagagatcttgtataaaagggtcatcattgactaaaaataacaacaatgtattcttccctgaatggcaagagttcaaagacttattgaaaattaatccctttagaagtagtctttggggagcaaatcattgagagaccatgggaaaaatctgggtaaagtacatgtatagaagtattttaaaggaattcatacagcca

SEQ ID NO: 407124 - DNA, 787 bp, Homo sapiens
gagggctattgctttatttctgaggtggctcacgtttggatagaagtagcaactctccgcttacacctgcacgtttaaaacgcatatcagattgtgttatttctgtcctcagaatcttcctggccttcccgttgctttcaggataatacacatttcttagcctaacttcaagggcctacagggtcttgattctgctgagtttttcagtctttgctactttcatggaaaacacacctgcaggtacactcatattatgctcccaccatgccagtctacggtaatttaataactttagatatggcaaagttttatatggtttactcaagttttaatttttgttctagcatttagccaaaatcgattgaattcataatattgctaggcactgttttaaaaacgggataaaatgaaaacaaaacaaaacacaaaacaaaagtcttcagtcctttaaaaaaataaaacagcttcctgacacatagttcacctaccgtagagttcaccatttaaaacgtagcggtgcctcacgcctgtaatcccagcactttgggaggccgaggcgggtggatcacgaggtcaggagatcaagaccgtcctggctaacacggtgaaaccccgtctccactaaaaatacaaaaaattagccgggcgtggtggcgggagcctgtagtcccagctacttgggaggctgaggcaggaggatggtgtgaacccgggaggtggagcttgcagtgagccgagattgcgccactgcactccagcctgggcgagagagctagactccatctca

SEQ ID NO: 407125 - DNA, 376 bp, Homo sapiens
tttggaaagatctggattgaacaaggcctcatcgatagtaagggccaagatttggtccccaaggaattaattatgcaagtattagaaaatcttcagctgccggaagagattgcggttgtccatgtcccacaacaccaacaccaaaagaactcatcttttgaaagctggggaaataacctcgcagatcaagtagctaagcaagctgcctcttcccaagtgtcacccattttccatctaacttcttctcttccccctccagctgcaatccccatcttctcccacgcagaccaagagaaactaaagaaaacaggagctaaggagagcccaaagggcaagtgggtactaacagatggaagggaaatgctgtctaaacccc

SEQ ID NO: 407126 - DNA, 408 bp, Homo sapiens
aaggctaactgaaaccattatttgagatccactgggaggcttaagagagttttgaagatagagtgagttaacagaacaaataatgtgtctgtcaagccaaggagcacaggcggctggccacctcccaggactgggggaagcctagctctagacactcctccctgccactgtccccatccattgaaccaggctcttgatgcaacaagggtcacaaatgaggctaaatcagagaactagagatggtatgactggccagctgaaaagcccatcaaaaatagctactgaagccgggtgcggtggctcatgcctgtaatcccaacactttgagaggcagaggtgggcggatcacttgaggtcaggagtttgaaaccagcctggccaacatggtgaaacctcatctctaataaa

SEQ ID NO: 407127 - DNA, 614 bp, Homo sapiens
tttgtttgtttgcttgcttatttatttctcatgctcctagaacataagctctatgaaagtagagactttgtttggctttttcagtgctgtgatttgaacctaaaaatgtgctgtgtcctgcacatagtattaataaatgagttaaatgagtgaaagaaataaatgtcaggctggtagtggtagctcgtgcctgtagtcccagcactttgggtggccaaggcaggcagattgcttaagggcaggagtttgagactagcctgagcaaaatggtgaaacactgcctctacaaaaaatacaaaaattagccggccatggtggtgtgcatctgtagtcccagctacttgggaggctgaggtgggaggatcacatgagcttgggaggtcgaagctgcagtgagctgagattgtaccactgcactccaccctgggtgacacagtgagaccctgtctcagaaaaaaacaaaaagtaaaaaaaaaaaaaaaaaaaagtctacaatttctactttaaaaatacctgaagccagtgttcatgttggagctcattgattcctcatgaattgtatcattgttcagtgtttagaacagtgcctggcacatgctaagtagcatgtagat

SEQ ID NO: 407128 - DNA, 190 bp, Homo sapiens
tttttattgtatgtactttctaaagtaaactatatagctcctgtaattaaaaaaaaaagttaaataaaattagtggggcacagtggcacacatctgtagtcccagttacttgggaggctgaagtgggaggattacttgaattcaggagtttgaggccagcctagacaacatagcaagaccctgtctccaa

SEQ ID NO: 407129 - DNA, 727 bp, Homo sapiens
gcaaatattccaaaatccaaaaaaattcaaaatccgagatatttctggtcccaaacattttggataagagatactcaatctataccatttttccttaaaggaaaccagagctctttggagaagtggttaattctaaggctggggcagggaaaatacaggctgagcctggaggatgttgtggtcagcctgaaagagctcccagtggccaaagctggaacaatttcatcaataaaataactacgtataatattgaattataatctgatttataaataaaatgtatacacatgagtccaaattgatatacataaatgactgaataagtaaataaatggggggagaagaactctttcttgtagaagactttaataaatgtaaaaggaatgagggaaatagaaaattgttgtcacaaagccacagcagtaattgctgcatgcaacttccactaatactaaaattagtgaggtgggccaggcatggtggctcacgcctgtaatcccagaactttgggatgctgaggtgggcggatcatttgaggtcaggagttcgagaccagactggccaacatggtgaaaccccatctctactaaaaatataaaaattagctgggtgtgatggcggatgcccataatcccagctacttgggaggctgaggcatgagaatcagttgaacccaagaggtggaggttgcagtgagctgagatcgcaccactgtactacagcctga

SEQ ID NO: 407130 - DNA, 1010 bp, Homo sapiens
ggtttgttcctaaatctaatcgagctcccaaggaactagtatcttatagaacacacatagaaaatagtgctctacagtagtcactttcacatttttttcttggatccaacttcatgataagaaatacattttaactcataatctattcacatgtatatgaataactgaaacagaagtttcacaaaattatgattatgtttgccacaaatggtgtgctctaatattttccttctgtttcatcagaagaaaaatactggttactatccagctaagctgattttgtgacccattaatgagtttcagttctcactttgaaaacactgttctagaattacagaaaggtctagggatgagaactaacaccactgtgcatcacagtgtgtcagtctgtgccaggcagcttataaatattttttgcctctaatttttatacatttatgaggtaagtatcattttctaggtaaggatgctaatctgtctccaagccaaataacacacagtaaatcatggcaccaggatttgaatctgggtctttatacatcatagcccatgctgttctcactgtattttgctttttccaagtataaccccgttttcacacgaatggccccttcacatatttgaagactaccgtcgtgtccgtgctgaccctttctccctgccacacatggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtatttttctcta

SEQ ID NO: 407131 - DNA, 631 bp, Homo sapiens
  misc_feature (3)..(4): n is a, c, g, or t
  misc_feature (8)..(9): n is a, c, g, or t
  misc_feature (11)..(12): n is a, c, g, or t
  misc_feature (16)..(18): n is a, c, g, or t
ggnnattnncnntgcnnncccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggagagagtttcattctgtcgcccaggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtatttttctcta

SEQ ID NO: 407132 - DNA, 609 bp, Homo sapiens
  misc_feature (3)..(4): n is a, c, g, or t
  misc_feature (8)..(9): n is a, c, g, or t
  misc_feature (11)..(12): n is a, c, g, or t
  misc_feature (16)..(18): n is a, c, g, or t
ggnnattnncnntgcnnncccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtatttttctcta

SEQ ID NO: 407133 - DNA, 1032 bp, Homo sapiens
ggtttgttcctaaatctaatcgagctcccaaggaactagtatcttatagaacacacatagaaaatagtgctctacagtagtcactttcacatttttttcttggatccaacttcatgataagaaatacattttaactcataatctattcacatgtatatgaataactgaaacagaagtttcacaaaattatgattatgtttgccacaaatggtgtgctctaatattttccttctgtttcatcagaagaaaaatactggttactatccagctaagctgattttgtgacccattaatgagtttcagttctcactttgaaaacactgttctagaattacagaaaggtctagggatgagaactaacaccactgtgcatcacagtgtgtcagtctgtgccaggcagcttataaatattttttgcctctaatttttatacatttatgaggtaagtatcattttctaggtaaggatgctaatctgtctccaagccaaataacacacagtaaatcatggcaccaggatttgaatctgggtctttatacatcatagcccatgctgttctcactgtattttgctttttccaagtataaccccgttttcacacgaatggccccttcacatatttgaagactaccgtcgtgtccgtgctgaccctttctccctgccacacatgagagtttcattctgtcgcccaggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtatttttctcta

SEQ ID NO: 407134 - DNA, 442 bp, Homo sapiens
atgaacctgtaaaagaatgtaggttttaaggctttggtaatataagttatttctttcttatttatttatttatttttaagagagtttcattctgtcgcccaggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtatttttctcta

SEQ ID NO: 407135 - DNA, 983 bp, Homo sapiens
ggtttgttcctaaatctaatcgagctcccaaggaactagtatcttatagaacacacatagaaaatagtgctctacagtagtcactttcacatttttttcttggatccaacttcatgataagaaatacattttaactcataatctattcacatgtatatgaataactgaaacagaagtttcacaaaattatgattatgtttgccacaaatggtgtgctctaatattttccttctgtttcatcagaagaaaaatactggttactatccagctaagctgattttgtgacccattaatgagtttcagttctcactttgaaaacactgttctagaattacagaaaggtctagggatgagaactaacaccactgtgcatcacagtgtgtcagtctgtgccaggcagcttataaatattttttgcctctaatttttatacatttatgaggtaagtatcattttctaggtaaggatgctaatctgtctccaagccaaataacacacagtaaatcatggcaccaggatttgaatctgggtctttatacatcatagcccatgctgttctcactgtattttgctttttccaagtataaccccgttttcacacgaatggccccttcacatatttgaagactaccgtcgtgtccgtgctgaccctttctccctgccacacatggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacagatgcggccgaagttttttctatcttttactctcggtggaaataaataatctaat

SEQ ID NO: 407136 - DNA, 520 bp, Homo sapiens
ggtcccctcggggcttccccttgggtctcagcgcaaagtcgggcggcggggccggatggacccgaggcggacgaataacgaggagctgcgagacgccaccttcttgctggcggcgggggagggcggcttgctagacgacctggagcgtctgtcaggctaggaggagggggaggagagctggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtatttttctcta

SEQ ID NO: 407137 - DNA, 957 bp, Homo sapiens
  misc_feature (946)..(946): n is a, c, g, or t
ggtttgttcctaaatctaatcgagctcccaaggaactagtatcttatagaacacacatagaaaatagtgctctacagtagtcactttcacatttttttcttggatccaacttcatgataagaaatacattttaactcataatctattcacatgtatatgaataactgaaacagaagtttcacaaaattatgattatgtttgccacaaatggtgtgctctaatattttccttctgtttcatcagaagaaaaatactggttactatccagctaagctgattttgtgacccattaatgagtttcagttctcactttgaaaacactgttctagaattacagaaaggtctagggatgagaactaacaccactgtgcatcacagtgtgtcagtctgtgccaggcagcttataaatattttttgcctctaatttttatacatttatgaggtaagtatcattttctaggtaaggatgctaatctgtctccaagccaaataacacacagtaaatcatggcaccaggatttgaatctgggtctttatacatcatagcccatgctgttctcactgtattttgctttttccaagtataaccccgttttcacacgaatggccccttcacatatttgaagactaccgtcgtgtccgtgctgaccctttctccctgccacacatggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacagaggtgtcgcccgaagcnccttttttttt

SEQ ID NO: 407138 - DNA, 335 bp, Homo sapiens
gcatacttaatctccaatgatttttaaaatgttaaatttattctctcataggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtatttttctcta

SEQ ID NO: 407139 - DNA, 415 bp, Homo sapiens
ccattccttcggcccccaaggggtctcacccaccccatgtcctatcactttaacccaggttaatcaccttaaccttcgagttgcccttcccacaaacacctaaggaattggacatctggctaatagtaagcttatccttccttagtgctgtcaccactctctaaatttcagtcccccatattgataaaccattcaacatcctacctagctcactggcctttcccaaacttgcactccattaccactaggaacttgtcattacctgaaacatctccacatcagaaaagtcaaacatatcaaatgtaatgattataatgtatcaaatacaagttatgcagatctaatgcatggcatggtgactgatacaactgaaatttactaatagagtagaacttaaatgtcctgatcacagaca

SEQ ID NO: 407140 - DNA, 854 bp, Homo sapiens
tttttttgtgattttttgaggtattagtattacattttctatgacctctgcagttagtcttcatttcttttaggaaggattccatttttatgaaaaaacaatttcattgaaaccaaacagtagtgaaaagagtgatatttaaatatgagttggtaagtcgtttttgaatacacatatggtttaaaaatctaaaatctcttgacacttgattaaatagagagagggaggagaaggatggtcatagaaaatgaatcttgcccttgatgtgatagtatggaatatttaagccaaaatctgtagtctcaaaggatttattgatgttttattgccagccagtcttcttccctgtttagaatgctatgtttttctgccaaacactgaggatacctaatagtttcctaagtgtttcttctgaataattaagtggattattttcagagatagactcttcttttaagtattctggggcttgtgtttttttcccttgttttctagcattttgacataggtgcatattatgtttttctttttcttttttagcaaatggggaaatgaaggcactgagaagataaataaacaagtttttgtgtgcgtgatttaaagagatagtctgaccattcatgtaaagtgttcagaacagtatctggccataataaatgttcaatcaacattagctataacaattattatcaaataagataaaatatgtgtagagtttgctatgcagtagaaatacaaagtgaggctgagtgtggtggctcacactggtgaaccactttgggaggccaaggtgggaggatagcttgagctcaggagttcaaggtcagcctgggcaacatagtgacacctcgtct

SEQ ID NO: 407141 - DNA, 410 bp, Homo sapiens
tgcttaagaacagtttcttcttcactccctctctcctaccacttctgctgccctatatagtagctttacactccctttgtgttattcttgaattgttaacgctgcttctcaatttttctctctaccctaccacttattcccagtctggaaaagtaaatagtgattgaggaggtgaggaggagcccaggaggaaggccgtgtatttcagaacacccctctctctcttccacccagatagcagtcccctgagttcatgtgctttcccactccacttctctctctgccccacccttagaagttccaaaaatcaggctcctctgcccgttggtgctccttatgtggtaacattggcgtggcgataccttacctgtgcatcatagaggggccccaccttgcagccctgtttgtgt

SEQ ID NO: 407142 - DNA, 335 bp, Homo sapiens
gcctcacttttcactccacttaccagagtaacttttgcagccacttcctttggttccgggggattttgcagcataaatcaaattgtttcctggctttccctttgtcaacttaaaattctcatgacttgagtcaacttggttttcatctgattttcagattctgtattttattgctgttgtctgcccccagtgttctccattcttttggggttttgcccttgaaaaatcctttactgttatagtgagattcttagggagagaaagtagagtttatatgtgcaaatctgccatttttacccagaactccaaaacagtaatcttagtgcaaaaaaaaa

SEQ ID NO: 407143 - DNA, 428 bp, Homo sapiens
tgataagctctgctttcctcttgctcaggagctgatactaatgcaggcaatgtgttatgtttcccacgacacccttgaataaaatgccatttcctcaggaacagctagaaataccgatgctaatttttcctatgctcaggaaaagcaagagctctcctgctgcagtgggctggaaggagctctccagaaatattatgtcatcctaatttgcactgccaagggatgagctcatcggggcggggtctcatgaggctgcagctgtgccagttcctcacttgtatgatgtgcgtcctccaagctcgcctctccctcgttacccgctccatccaccccctgcctgcctgcgccaaacaagagccactgcatgatgaattatttaaaacccgaaggcgaactcttgcaaaatataaccaggcatcagaaggcac

SEQ ID NO: 407144 - DNA, 1927 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacaca

SEQ ID NO: 407145 - DNA, 1469 bp, Homo sapiens
  misc_feature (16)..(17): n is a, c, g, or t
agcaggctgtaccccnncgagttatgggatatcgtcgacccacggcctcgcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttg

SEQ ID NO: 407146 - DNA, 1029 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattaggtaaaggaaaacttaagttatttctagc

SEQ ID NO: 407147 - DNA, 287 bp, Homo sapiens
aacacctcaccacacctcccccccactcctcatagctacaagttttttttatcctttaggttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttg

SEQ ID NO: 407148 - DNA, 2362 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacacaaaaaaaaaaaaaaaaaaaaaaaaaaatcaatataaaaaagggggggcgcagccaaaaagtttccccggggggggccaaagtatacgggtacccaggttttgtgtgacaagggggccccatatggggagcgagatttatataaggtatgcgcatgtggcactaattatacaacacctcagaccagcgggcaaaccccgtcacgacggagaaaatccggggacgaagaaacacccttactcgcaggcggggaccacattattgtgcaaccaacattccccttaaaggattttacaaggccctccaagggaacaaatatatacaaccttgtcaaagggggccaaacgcgtgtaaacacaccgcgtcacataagcctgcgtgttagaaaaaatttggtgcaactaggaaatgtcatatctcgagcaaatttctattcac

SEQ ID NO: 407149 - DNA, 1958 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacacaaaacaaaaaaataatggcctccttggcctca

SEQ ID NO: 407150 - DNA, 1720 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttg

SEQ ID NO: 407151 - DNA, 1999 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgaagtgaggagtcccaaggagcaatacatcgaagcatgtctcagccagaggctagcagcagcagctatgacagttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacaca

SEQ ID NO: 407152 - DNA, 2059 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacacaaaaaaaaacagacacaaaccctaaaaaaaaagggggaacaacatttgtgcgcgcgcttggggcccctgagaaacttttttaaaacacatctttatgggagagggcccacatatgtatagtagaacgtgggacacagggtctcccaagagaaactcgggggaagaagaggggtgtggttctcccataaaaaagg

SEQ ID NO: 407153 - DNA, 1785 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaaggtgggcctcatgagagatgtggagtcctcatcacggggttgcctggtgattatggaataagcagcggacttacagacactcagcgtccaggcgcaccaggccaccacatcccagacatgagtacctgtgcaaaatgcattcattcctccatcttggacgagtttactgagcacctgtgatgtgccaggcactaggggtgctgcagcggaagagctaagcattgagggtttgtttgtttgttttttgttttttgagacagagtttcgctcttgttgcccaggctggagtgcaatggcgcgatctcggctcactgcaaccgctgcctcccaggtacaagcgattctcctgtctcagcctcctaagcagctcgaattaacaggcatg

SEQ ID NO: 407154 - DNA, 1691 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaaggtgggcctcatgagagatgtggagtcctcatcacggggttgcctggtgattatggaataagcagcggacttacagacactcagcgtccaggcgcaccaggccaccacatcccagacatgagtacctgtgcaaaatgcattcattcctccatcttggacgagtttactgagcacctgtgatgtgccaggcactaggggtgctgcagcggaagagctaagcattgagggagaccagaactgccttctgaatgccattatgacttgactcagctgggaaccacgagaggacga

SEQ ID NO: 407155 - DNA, 1589 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaaggtgaattttgttattaaattattctttggtcttcttgtgtttataattgcaataaatactaaaagaaagtatagcagtagttcaatgaagaacaataacagattgcatggcaattaaggcaaacattttttgtaatacagaaaatgtgtagagggttgtagaaaaataaatatttatatatttcttat

SEQ ID NO: 407156 - DNA, 1676 bp, Homo sapiens
  misc_feature (16)..(17): n is a, c, g, or t
agcaggctgtaccccnncgagttatgggatatcgtcgacccacggcctcgcagaacgcgacgggtctgcggcttaggtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacaca

SEQ ID NO: 407157 - DNA, 1837 bp, Homo sapiens
acgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacaatttgcagttggagagataataactgacatggcaaaaaaggaatggaaagtaggattacccattggccaaggaggctttggctgtatatatcttgctgatatgaattcttcagagtcagttggcagtgatgcaccttgtgttgtaaaagtggaacccagtgacaatggacctctttttactgaattaaagttctaccaacgagctgcaaaaccagagcaaattcagaaatggattcgtacccgtaagctgaagtacctgggtgttcctaagtattgggggtctggtctacatgacaaaaatggaaaaagttacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacaca

SEQ ID NO: 407158 - DNA, 1288 bp, Homo sapiens
  misc_feature (12)..(12): n is a, c, g, or t
tctagaggatcncggcatatggtatctcagtgtagtggagaatggaggtagaaagcaaaacatacaaattacaggtttatgataatggatcgctttgggagtgaccttcagaaaatatatgaagcaaatgccaaaaggttttctcggaaaactgtcttgcagctaagcttaagaattctggatattctggaatatattcacgagcatgagtatgtgcatggagatatcaaggcctcaaatcttcttctgaactacaagaatcctgaccaggtgtacttggtagattatggccttgcttatcggtactgcccagaaggagttcataaagaatacaaagaagaccccaaaagatgtcacgatggcactattgaattcacgagcatcgatgcacacaatggtgtggccccatcaagacgtggtgatttggaaatacttggttattgcatgatccaatggcttactggccatcttccttgggaggataatttgaaagatcctaaatatgttagagattccaaaattagatacagagaaaatattgcaagtttgatggacaaatgttttcctgagaaaaacaaaccaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaagaagcgaaagaaagaaattgaagaaagcaaggaacctggtgttgaagatacggaatggtcaaacacacagacagaggaggccatacagacccgttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacaca

SEQ ID NO: 407159 - DNA, 737 bp, Homo sapiens
ttttgccctgattttattactatgttcttcattacatattatggttagaacatcctttggtttaatctgttttaacccaaagaatacttgagatacctgaagagggaatatataacttcacactgaaggcgagaggttttgaagtagtccctctctttttcccgctgctgtcttcctttcgctactgtcttttttcctcctttcccctgtcttgttcattttgttattaggaagtgaggagtcccaaggagcaatacatcgaagcatgtctcagccagaggctagcagcagcagctatgacagttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacaca

SEQ ID NO: 407160 - DNA, 494 bp, Homo sapiens
aacacctcaccacacctcccccccactcctcatagctacaagttttttttatcctttaggttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacaca

SEQ ID NO: 407161 - DNA, 546 bp, Homo sapiens
caaatttaaattttggagagaaatatttcagtattagtaaaaattagatacgttttatcagtcagtatttttatatggcttaagagaaggtaggttttgtcagcatattttttgacatattaaaaaatgacccaattttctaagattttcagagtattagcaatcatacctttgtatgtcagttttatctttgcaaatcacgagagtcgatttgattttaaaatgttaataactatatttagggatatttatatttctgttcttttgcttttgtaaattattgactagtgatttcagtttctttgatttttcttcaagggttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaattt

SEQ ID NO: 407162 - DNA, 3498 bp, Homo sapiens
tccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcctgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatgggtcagctggcggtccatctccaggcgctgccgctccagggccacctccagccagtacaccagcctctgctgctcctccagctgcatctccagttccgagaaggcaatctgctgctggtgctgctcctctcggagcgtcaccacctgtcccaagacccagccaggctcagccctcatcatgacccctcttcatccagctaatcctcaatcacagacacagtattggcacacttgccaccacggcactaagaaatcaccagggtcttccctgctgagccaagactcagcctcagacacctcagcagtgctctagttatcttccaacgatcagagctggctctcaccttatctgctatctctgccacaaaccctttcctagccacacactatggagctgggcagagcgtcaagttgtgggatttcatctagaccaacctcagcactatggacatctgggaccagataattcttggttgtgggggcctgtcctgtgtgttataggatgtttagtaacatccctggcctccacccccaccactgtgacaaccaaaagtatctccagccatggccaaatgtcacaaaagggcaaaaacttcccctactgagagctactattgtggccatggaccaccctgaggttagccaatcagagcagaagtggggggcgggtaggaaactgggtcttagtttcacaagtaaaataggctttaaggtcaggcggccctgcagatgagttggtcctgattctgtcccccagtctgggaggaaacgggatatccgctggagcagctgccatgagacacctccccacacgtgccgctgaggaggagctggggggccatgggctgctggcccaccttgtcaaaatacttgcagaggagggctctggtctctgaggatgagaggtagctgagcttggccatgaggttcatctcgcactgggacagcaacgaggctgaggcccgaagcacccgctggcggcatgtgatggcctcattcttatactcaatggcagcatccagggcctcgatggcctcatccaactggaacagcgtccgctcctcctgcagagacgggcacgcgtggaggaacagcacccactgcctgaatgctgaagtcctgggcagacatgcaacagccaacacgtagccacaactgggccttaagggtcccctcgtcccaagggccaagtcagcgcatcgagagaggtgccccctgctcactgtcacagccccaaccccagggtgagctgggggcactgctcagaggtggcctgctcaactgcaagcctctgtgaatgatctacattcaggaagttcagagcaccctaaccaaacaaaaggcatggttgggacagccacggaggcaccacggtgtctgctgggtaagcttctacagatggggatacgttctaagaaatgcatcattaggcgttttcgacgtcgtgcaaacatcagaatatactcacacaaacctagatggtatagcccaccacacacctaggctacaagcctggacagcatgtgactgtactgaatactgtaggcagttgttaaccatggtgagtatttgtgtatctaaacatagaaaacgcacagtaaaaatgcggtgttataattttctggg

SEQ ID NO: 407163 - DNA, 2412 bp, Homo sapiens
tccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcctgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctc

SEQ ID NO: 407164 - DNA, 510 bp, Homo sapiens
ggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggtgagttcgtttttgaaacccagtttcctcatggtttcttttggtcagagtgcttgacaaggaggcacttgggagttgcttcttgggaggcctgggcttcccggttgggg

SEQ ID NO: 407165 - DNA, 393 bp, Homo sapiens
agctgggaccacaggtgttcgccaccatcccaggctaatttttaaattttttgtacagatgtggttttgctacattgcccaggctggtcttgaactcctgggctcgagcaatcctcccgtctcagcctcccaaagtgctgggattacaggtgtgagctaccacgtccggccaagatctgcttcttctgaaaccatggcaagagaaagacagacagacttggacctactgcagggagggttaagtagcagcgggactcccatcaagaagaaggaatgtcttccggagcctcatctgtctgttgggctggaggcagggcctttgtgaaggcgggtggtgctcagatcgcctctgggcccttcctccagccccgaggcggattcaccatgaggctg

SEQ ID NO: 407166 - DNA, 341 bp, Homo sapiens
taaaaaaggagtccctgcagctccagcacggagacacaggggctcaacagagtgcttcctaatagctttttgtcttgagtctagaccccttttgattagttaggaattagcttagttacatgtaatagagattctgtttttccttttctgggtatgccccacattcatctatatattcacatattccacagatatttgagtgactgcttttaccaattttagcttaagccctgcagatacagagctgaacgagaacgttcaatccgtgttctcttgaaacttaacgtagttacgtgaaggttaatataggaccagtaatcacaactgtgatgaatgttata

SEQ ID NO: 407167 - DNA, 1552 bp, Homo sapiens
gcatgcgccccaatttgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgccggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcacctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 407168 - DNA, 1163 bp, Homo sapiens
gcttaaggtaacgtgactctcttattaacgccgatcaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagactgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 407169 - DNA, 1122 bp, Homo sapiens
gcatgcgccccaatttgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgccggtgcgagtgcttgggattacaggcgtgagtcaccgcgcccgtgcaatgcccttggcattttatctggaatagcatctgtaaactgaagtgtttgacctctgttttcttctctcctctttcatctgtatctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 407170 - DNA, 1300 bp, Homo sapiens
gcatgcgccccaatttgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgccggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagagtgagcaaatagagtttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaataaaa

SEQ ID NO: 407171 - DNA, 1659 bp, Homo sapiens
gcatgcgccccaatttgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgccggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagactgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 407172 - DNA, 1896 bp, Homo sapiens
gcatgcgccccaatttgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgccggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagagtgagcaaatagagtttgcttagtgaaaaatgatactgaattctacataaatgtaaagtctttaatctgaggaccctgccccatgaattgtgcaggctgcattgaaacgccttggtgatctcatatttaggaagaaagcccttggcattttatctggaatagcatctgtaaactgaagtgtttgacctctgttttcttctctcctctttcatctgtatctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 407173 - DNA, 1206 bp, Homo sapiens
  misc_feature (41)..(41): n is a, c, g, or t
ccttcccccattccccatatattatttacctcgagagatgnagctagtctgcaacgactctcttattttccaccgctacacgagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagactgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 407174 - DNA, 2089 bp, Homo sapiens
  misc_feature (5)..(5): n is a, c, g, or t
  misc_feature (611)..(611): n is a, c, g, or t
tgagncaagatcgcaccactgcactccagcctgggtgacagggagactcgtctcaaaaacaaaataaaacaacaacaacaacaaaaaaatctgaggaggtggacaccattttttggtactgaacgacgtgatgaccgtttaaaaagaaaggtagatgttaagaaggcttccttatacaaaaattcttgtatattgttccttccaattttatttttgttttgatatataaaatcctatgttaaatctctcatcctgaatatcagattactccagaaggagaaagtagcagtctaattattttatttggttgcatggtagtcttagtacaattaaatctcctttgaaagtttctcagttatgtagttatgaatagcactccacaccacggctgtggtagacctggagcggtattgggcccaggtcacagaatgatcacggaaggactttagagatcacctattgagtccctgttttagagaggagcaagcaaaggcccagagaactcactccatttgccgaggtccgacaagtgtgtaggtgagctggagccagaaccctgtctttcggtcttcactctagagctctttccaaacaaacatgctgacctgggngtctgacaattgctgtatgctgatgtttcctatttgaagtccacatgtctttgcaggggaagagaactgtctagtatcattcgttaatgcccactcttcatgtttgccaaagaccaccaatacattgggcagtgattgtgttacactggtttgtttatatgtcggctttcagtgatgccagaaaatcaaaaggaggttaagaaatcccagaggttcacccaggatgggaggctaaacctttgttgtattatgagtcttaattcaagataacataatctttagcctaataaacattaggttgaattttgaaaatgtaaacactaactgatctgtagactgacgtctatttccttggcaatattggccacacccattaaataataacttctcattctcccttcccccagcctctggcaacctctgttatactttctgtctctgaatttgactactttaggtgcctcatataagtggaatcacatgacatttgtccttttgtgatacgatattttctttaaaaagaaaatgaacagaaacagtacatgagagaagtcaggtctgcagccagtgtgcctcttagttccatattcatacaaggccctcttggaagctcagctttggagttggatattatctcagaagatatggcagcttaggaatctggtactctaaaaacagatttacaagcattagacttttttgtatatgtgtgtggtcattttagtcttcctgaaagtggttaagaccaatatttctaggcagactatagttcacatcatccagttctgtaagtcttggattatcgatctcattgtcatggcaaaaaaggacagggattactcaactcattactcctgtgtccagacctctgagcctggtgtgtgtgtgtggctcagtgcctttcccatagtggcccacatccccccagggccctgcatgaagttcctgcaagtctaccccctgcacgtgcagagcaaaaagagcttcctatgggagctgttctccagaaaagacagaaacccgggccctagagaaccagaagatttaaattccagtttcagctctgccattgactaattaggcaactgtaggcagttcactttgctcctttggaccagagatttctcatctacaaaatgaaaaacttggatttaattatctctgaagtcacttcaagcagaaatgtaacaattctttgatttattaaaaaaaataacatcaatgataatgaccaacagctaacacttattacaaggctccaggcactttcgaagtccttaatatttaatgttcactactaccttaggatataagtactgtgatgcagagtcctggacacagagaagtcagcaacttgcctgaggacagcctgcaggacacagcactgtgatttgaacccagagagtctgacttcagcccccagcgctcagctactattaattgaaagggcattgaagagacatgatgtcacaaaaaaa

SEQ ID NO: 407175 - DNA, 2035 bp, Homo sapiens
  misc_feature (5)..(5): n is a, c, g, or t
  misc_feature (611)..(611): n is a, c, g, or t
tgagncaagatcgcaccactgcactccagcctgggtgacagggagactcgtctcaaaaacaaaataaaacaacaacaacaacaaaaaaatctgaggaggtggacaccattttttggtactgaacgacgtgatgaccgtttaaaaagaaaggtagatgttaagaaggcttccttatacaaaaattcttgtatattgttccttccaattttatttttgttttgatatataaaatcctatgttaaatctctcatcctgaatatcagattactccagaaggagaaagtagcagtctaattattttatttggttgcatggtagtcttagtacaattaaatctcctttgaaagtttctcagttatgtagttatgaatagcactccacaccacggctgtggtagacctggagcggtattgggcccaggtcacagaatgatcacggaaggactttagagatcacctattgagtccctgttttagagaggagcaagcaaaggcccagagaactcactccatttgccgaggtccgacaagtgtgtaggtgagctggagccagaaccctgtctttcggtcttcactctagagctctttccaaacaaacatgctgacctgggngtctgacaattgctgtatgctgatgtttcctatttgaagtccacatgtctttgcaggggaagagaactgtctagtatcattcgttaatgcccactcttcatgtttgccaaagaccaccaatacattgggcagtgattgtgttacactggtttgtttatatgtcggctttcagtgatgccagaaaatcaaaaggaggttaagaaatcccagaggttcacccaggatgggaggctaaacctttgttgtattatgagtcttaattcaagataacataatctttagcctaataaacattaggttgaattttgaaaatgtaaacactaactgatctgtagactgacgtctatttccttggcaatattggccacacccattaaataataacttctcattctcccttcccccagcctctggcaacctctgttatactttctgtctctgaatttgactactttaggtgcctcatataagtggaatcacatgacatttgtccttttgtgatacgatattttctttaaaaagaaaatgaacagaaacagtacatgagagaagtcaggtctgcagccagtgtgcctcttagttccatattcatacaaggccctcttggaagctcagctttggagttggatattatctcagaagatatggcagcttaggaatctggtactctaaaaacagatttacaagcattagacttttttgtatatgtgtgtggtcattttagtcttcctgaaagtggttaagaccaatatttctaggcagactatagttcacatcatccagttctgtaagtcttggattatcgatctcattgtcatggcaagtgtgtgtgtgtggctcagtgcctttcccatagtggcccacatccccccagggccctgcatgaagttcctgcaagtctaccccctgcacgtgcagagcaaaaagagcttcctatgggagctgttctccagaaaagacagaaacccgggccctagagaaccagaagatttaaattccagtttcagctctgccattgactaattaggcaactgtaggcagttcactttgctcctttggaccagagatttctcatctacaaaatgaaaaacttggatttaattatctctgaagtcacttcaagcagaaatgtaacaattctttgatttattaaaaaaaataacatcaatgataatgaccaacagctaacacttattacaaggctccaggcactttcgaagtccttaatatttaatgttcactactaccttaggatataagtactgtgatgcagagtcctggacacagagaagtcagcaacttgcctgaggacagcctgcaggacacagcactgtgatttgaacccagagagtctgacttcagcccccagcgctcagctactattaattgaaagggcattgaagagacatgatgtcacaaaaaaa

SEQ ID NO: 407176 - DNA, 462 bp, Homo sapiens
gttgaagcatttgtgtgatagctaatttaaaatgtgtcagataattctgaacatctctgtcattttggtggttgcaagtattgattgtgtttttgcattccatttgagatcttggtttgacaagtgattttttaaattgaaacctggatattttgggtagtatattatgaaactctggatctctggatcgtatttaaagcttcagttttagctagcttactctaatgctattctggcaagagaaatcagggctgccaccttattactgccaggtacaggtagaaattgaattttctactctgcattcattaacatctaaggaaggatatcccttgtgactgctgggcagggatgagagttctgggttcccactacgcttttactgatgctttcttgtctgaaagggataggagtgccttgttaccactgggtgatggtgaaagccctgacccttcactaggc

SEQ ID NO: 407177 - DNA, 408 bp, Homo sapiens
caaaaataacaataacaatccttgaaccactactaaagaaggtaaattgtagggactttatttagaacccactgagacagaattaaatatcaggattttcttattttacattgatgcctttccagacagtagaaataaattcaacagaagtctttagtctggtcactcagagacaatggtagcacattagacagtgtctctaccttagttgtatctcttgaaaacacacttatccaaaacattattaaggttttgaaattcagtctcaatccctaagaaatgttcacttcagcattgtttttcttacttctgtgagagctggaggttaaaactctgtgaatagtgcatggaaatgaagaatgacttttctgtctatcaaaagtatgaaaataggggctgggtatggtg

SEQ ID NO: 407178 - DNA, 446 bp, Homo sapiens
actgaaacatacaggagttgttgttgatggactgtttccttacttccgtttcctatagggacattgctgctgttcttatttgcaatgaaacactgaagaccctgaaacttgggcatgatgaaataggaggcgctggtgtcaaacagttatgtgatgctttgaagcaccctcactgtagatgagagtgtcttgcactgcaaacatagccgatcacccgtgcctgctgtgaagaccttgctgtggcactcactgcctgcaaaacatggaggagcctgaacttcgactgggttggttaccttggatgctgatgtggtggtggtgctgtgtgaggctttgagccacccggactgtgcactgtggatgcttggtgtcactgtagctgaaaggaaacttaaccatcttccctacatcggaagatttaaggctgcacaaatctgcctttgatg

SEQ ID NO: 407179 - DNA, 370 bp, Homo sapiens
agacccactgtcagggagacaagcagtgatggtgacctcaggtgacatttgaaacttcagaagagcacttatatcttttcagccaagagatttggggattcaaggtccaaaccagtccaggcttactcttttgtgctggtgggcagtaggaagcctgcaagtagtactatttaaaagagaaaatgacatgagccaccatgcccggcctctattaaaatcttttatctttttatattaatttttaaatttttatttagagacggggttttaccatgttgccaaggcttgtcttgaactcctgagctcaagcgatccacccgcttcatcctcccaaagtgttaggatcacaggtgtgagcactgtgccctgc

SEQ ID NO: 407180 - DNA, 453 bp, Homo sapiens
aacacagagggaaatttgaaaggtgtagttactggtattatcaccattatcctcattttgtaaatgaggaaacagatacctgagatattttgcccaaggccaattaggattcaaacccagacagtgtgactagagagagattgtcctacataggcttatggtaactattgcctgctcaaagtaatgctcacagtggtctaggggttcccttacagcagtggctaccaaccagccttctgggcaacacacatagaaatcacgtgggacctggtaaaaagtacagaatcctgggttctactccttggagattctcatttagggattaggtcagtgtttcacaagctcaagtatcacctggagggcacccggagagcagactgggaatccacccccagggtgtcaggttctgtaagcttggaacgggtcctgacatttgcaagcttttaattaatg

SEQ ID NO: 407181 - DNA, 359 bp, Homo sapiens
tcaccaaaacaaagaaattcaccaactcaaatttttccttgagctctcagcagcagttaacatagctgaccacacccttcttcctagaatgttttcttctctcatctgtctgcagctgacattcctctaacttgtctggtcttgttctccgtggccttttctggtcccacatcctctgaacctctcaatcttggggtgcttcaaggttgagttctggtctcccagtcctggtctctccctaggtaatcttactcgtttctgaagatttaagttccattctccgatttcaatctcctgcccaattcccaacatttttgcaatagaatgtctaaggagcactcaaaattaacatatctaaa

SEQ ID NO: 407182 - DNA, 975 bp, Homo sapiens
tgccaaatgaaatataatgatatcactgtaaaacccgttccattttgattctgtggaatatatattgactcaattttcttcagacatactccccagccgcagagtcttacatcaggcggtctgtgcttgagctttggggaaggccacagcctgatccggataaggtcaatggggagatcctcaaaagaggctgctgcctgttatgactccggctgatggcaaccatagtagaggtggccacttactatggttgccatatgggaccccaggagctcgtcagataaacatccaaagaaagaaaaataattatttagctgcctggccattctaaaagattttgccaaaaagaaaaaacaaaacaaaaaacaaaacggtgagtatggggagaaaaagggactaatgatctcacagtctctggccatcccaagaaaaggctgctgcctagagataccttcctcctcccccattttctcctatcagtcagatataggaactaaaaatggtgttggcttcaagcccaagagggaaagaaaaggaactttaaaccctatagtccctattcaccaggtcccgcaagtatgccagtcctagattacttaaaatttcaaaacaaacttggccaaacttcaggcaggcccctcagcactgaatgccctggcctacaagtagtgacatcgttacatttattataaacaattggagcattgcctaaaaattgttccttgaggcctggcgcagtggctcacgcctgtaatcccagcactttgggagactaaggcaggtggctcacgaggtcaggagtttgagaccagcctggccaacatagtgaaaccccatctctgctagaaatacaaaaaattagccgggcgtggtggcgggcacctgtaatcccatctactagggaggctgaggcaggagaatcgcctgaacccgggaggcagaggttgcggtgagccgagataacgccactgcact

SEQ ID NO: 407183 - DNA, 878 bp, Homo sapiens
tgagactccaggcatccaccaccacacctccctaattttttgtatttttagtacagacagggttttgccatgttggctacgctggtctcaaactcctgagctcaagtgacccgcctacctcagcctttcaaagtgctgggattacaggtgtgagccactgcacgcagccatgttttcagttttcttgagggagattcctaggagtagaattgctgggctgtgtggtaacttccaggcctccttaaagctttagcctggactgggtagagcatggtttccactgcattctcttagtcacagtgagttgcaggttcaccccagcgtcagtggcgggcgggaagtggggatgacacaaggacctgagtgtccaagggggcttcatggagccctcatgtgaagtccccagcatggaccctgacacatcgtaggtcctcaacaaatgtcactccctgttgtcactctgtttagtactaagaataatgatataaaactgggacagtaaggaaaacacaaactgttgggacctatatctgaatctattagtctgcctaatagaaaagccaccatcaggattttggagattacaagctcactttagattagccatactggagtcagccctggaggctcccagagatcagaacaatcccagcgcttgacaggatggctgggaaacaatacatatgaatgccggaaaatgcagaactaatctaggaaaaagtgtaagaagaaaataaacatcatctgtcattctatctatcagagataactgctgtcaatattttggtttccttccaatattttttctattcactctgtgcataagtatgtatattttaataaaagtataattaagatcacaatgtaaatagtttata

SEQ ID NO: 407184 - DNA, 1738 bp, Homo sapiens
attcagaagcaggaactccttcaggtatagctggatctaggtgctcatccagtgaggtctggcacaccatctccttcaggtatagctggatccaggcacttagagaatgcagtgggaactagatttttctttctgcttcagcctgtcaggcctgctttcctctgtgttagctttactcttaaacaagctattcccaaatatggccactgttagtttcatgctcatatcttacagcttagcaagtacagtggattggccagatatgagtcatgtgcccacccctggagcctacccaaacccaggaaccaagagggaggaactaagagtggttcccatgggaaaattgggaggcctccaatcaaaagaaggaggaaaggaaaagcaatcattgaccctcactccccattatagttcacttcatgcagccaggcaccacctaccataggctgctctgctccactcttgattttgacttttccctttctttcacttttatttttatttacttatctatttatttgagacagagtctcactctgtcacccaggctagagagcactctcggctcactgcagcctccgcctcccaggttcaagtgattcatgtgcttcagcctcctcagtagctgggattacaggcgtgtgctaccacagccggctaatttttatatttttagtagagatagggtttcaccatgttggccaggctggtctcaaactcctggcctcaagtgatcctcccgcctcagcctcccaaagtgctgggattacaggagtgagccaccatgcccggccttacttttattttatttatttttatttatttattttttctttgagacagtcttactgtcgcccaggctggagtacagtggtgtgatctcagctcactgcaacctccacctcccgggttcaagtgattctcctgcctcagcctcccgagtagctgggattacaggcacgtgccaccacacccggctaattttttatttttagtagagatggggttcaccatgttggccaggctggtctcgaactcctgacctcaggtgatccgcccgcctcggtcttccaaagtgctgggattacaggcatgaaccaccgcgcctggccttacttttaattttaattacgtaaatcaggacttcatctttatataatgttcacatattacaaaggtacatttcagcctactccctccctttcttgtcatttttttttaatgaaaaaaagttgttttttttttttatgagagatgaggtcttactgtatggcccaggctggacttgagctcctggtctcaagccatcctcctacctcagcctcccgagtcgctgggcctttctttctatttaaatttatatttacagggttttgttttgtttgttttttaatcatcaatcaaattttaatgtccatttatttatactttgtgtctttcctggagagctgttcacaagagtatggaggccttccttattcagtgtgactggtgcctggtgttcctagtgtggagatactatgatttgttatctacagtgattaaatctagattgtttccagtttttcactattgaaagttgtgacctgaagctggttgtggcaatgtgtgcctgtagtcccagctacatgagaggctaaggtgggaggattgcttgagctcaggaaatcaaggctgcagtgagccatgatcatgccactgcactccagcctgggcaacagagtgagacttcgtatct

SEQ ID NO: 407185 - DNA, 2190 bp, Homo sapiens
  misc_feature (1391)..(1391): n is a, c, g, or t
  misc_feature (1427)..(1427): n is a, c, g, or t
  misc_feature (1657)..(1657): n is a, c, g, or t
ctcataatttatttccatgcatctttgctttggatcctagctttattggtgaacatttatgcctttctatagcaatctgggttttcttagccaattgaaatgggcatttattagatcatttaagcatcatatcaatatagtatatttggcgactttatgataagttcttatgatagatgttcaaaactctgctcaggtgacatttttatggatccacatagtttttgtcatatatgaaaagaaagcattgagttgtgcagatggttaaatgtgcattgagttatttctctggaatttgcatgagaatggaccgacttgtagttgtattaacttttctagtgcccaggttagaaagtttgatctgtgtagtttttaaaggcagcatccaaatcacttatattcagaagaaaatggtaacagatttagaagctgtctatattttccccattatccataatacatattattggcaatatggttttcactctttgttgttaacgtatcaacaatgtgcaatagccactaataatcatttgttaatgcatgcttccaagttctgtatttgaaaatctcagacttcatatatggtaagcgatggagtaatttataacttttatgttgaattcttgctactttaaaaaattgtgcttctccttttttaaagcatatgacttacttaacagctgatagtcagttacctggatttttagtatttttttacatcacaaaaagatttctctgaagtttgcgcaggggtctatttgtaggcagtttccaacttactaataagtaaggttctgaaagttataagttagctgtctggaatagatagtctcatagaaaccaggttgtagatggtgatttggttccttgggcaacctactgaaacccatttactatataatgtggctgaataatattattgatagtgctatagtatttagcaactgtctgtcaagtgattttgaactctcattttgaaatctaactttcatagcattattctgatgaatttttggtagtgcgatttgactttttctacctccattctaccagttcacagtgcattctagcagtggaaatcaaaaaacctattgagatggaatttgggaggaaaggaggacttactgatatccctagctgtagaaagaaagtaactgggtatcctgtctgaaagaggaaggatgtgatgatcttcatggctctgttgtggagatgtatgtctgcttatacatggcaggcaaccaattggaggtttatatattttaaaaataaagaaggggcggccgggcgccgtggctcacgcctgtaatcccaacactttgggaggccgaggcgggcagatcacggggtcaggagatcgagaccatcctggctaacacggtgaaacnctgtctccactaaaaatacaaaaaattagccgggcntggtagcgggcgcctgtaatcccagctactcaggaggcggaggcaggagaatggcgcgaacccgggaggcggagcttgcagtgagccgagatggctccactgcactccagcctgggcgacacagcgagactccgtctcaaaaaaaaaaaaaaaaaaaaaagaaggagcattttataattttacactgattagccaaaggatggagaaacccaatacttctgctcgttcancatgcctcacagtatattccaagtattttcattgtatatcttctacttactctaccaccctatgccccacaatttggactcttggtttttaaatggtagtacaggtaagagtagttaagtttctaataccagaatagttttgaaatatattattgttattatcatcatcatgtagagacagcatctcattctgtcacgtgggctgaagtgcagtggtgtaatcatagcttgcactgcagccttgaactcctaggctcaagggtttcttaagccttagtcttaatatacagctttataagtgtgcattactgttcacagctaactttaaaattgttttttgtaaagacaggatcttactatgttgatcagactggccttgaacccctgggttcaagggatcctcctgccttggtctcccagctactcaggaggcggaggcaggagaatggcgcgaacccgggaggcggagcttgcagtgagccgagatggctccactgcactccagcctgggcgacacagcgagactccgtctc

SEQ ID NO: 407186 - DNA, 242 bp, Homo sapiens
tgccactttttaaaaatctgctttctgaactattttaatagccatttaaaaatacttgctttatacttttttttccagaaaatgtagaaatgtgcattagaaatttttttttcactttttgacagttatgtaaaatgacttacaggttttagttatggccattaactccttttactgtcactcacttcctatagttttatctttttaaatgtatgccctcttttctggcactgtatttaaaa

SEQ ID NO: 407187 - DNA, 651 bp, Homo sapiens
taaaattgaattatcttattatgtcctagtttcaagttctgcatcagattatgaattgcagtttttccttcccacattgtagtttgcatttttcattcccttaatggtgtattttgatgaacagaagttcttaattttaatgtagcacaatttatcattgctcccttaatgatgagtgtttttaattatctatttaagaaatattagctatgttttacaacatttaaaaactcatttgatggtagtatacagacaatgacactctgatgggtaaaaggcagaactctttgttactggcagctccaaatcagagaaggctgccaggcagggccccataggggatttcacccaagaccatggtaacaacaagctggagctacacggggcagcttatggtaagcaggatgtgtttagctaggtcttccaagcttctcacggattgcctaatctgaatgatctccggggctccagtgtatagggactatccttaattgtttcctacctggttctggggcaataggggcaggcgcacagtggccttagtgtgtgagatcaaaatagtagaaatagttgaagtgtggctttaatcagctgctcagaaaggaaaactgattgtcctctagccagggcttcaggactgggtcaagaaac

SEQ ID NO: 407188 - DNA, 565 bp, Homo sapiens
gagatggaatctcactctgtcgcccaggttggagtgcagtggtgcaatctcggctcactgcaacctccacctcctgagttcaagcgactctcctgcctcggcctccctagtaactgggattacaggcacccaccatcacgcctggctaatttttgtatttttagtagagacagggtttcgccatgttggccaggctggtcttgaactcctgaactcaggtgatctgcctgcctcggcctcccaaaatgctaggattacaggcgtgagccaccacacccggtgggttgtctttttattgttgagttgtaagcattctttttaatattctggatactagtttcttatcaggtacaatctttgtgaatatattctcccattccatggattgtcttctcactttctggatactatacagtacaagttttaaattttgatgaagttcacttgatttctgttttttatgttattgcttatgcttttggtgtcatacctaaaaaaccattgtctaaatcaattgcctatgaggtgttacccctatgttttcttctaaagttttatgatttta

SEQ ID NO: 407189 - DNA, 171 bp, Homo sapiens
aaatacaaaaaaaaaaaaaaattagccaagcgtggtggcatgtgcctgtagtcccagctattcgggaggctgaggcaggagaattgcttgaacccaggaggtggaggttgcagtgagccaagactgcatgactgcattccatcctggacaatagagggagactcaatctca

SEQ ID NO: 407190 - DNA, 391 bp, Homo sapiens
acgggacataaccctgtcgtaagttgaggagcatctataaaataattctagtaaagttcacttactctttcgtctgattttataatttagaataattattacctacttaaatattacttgtttttattgactccttgctatgaaagatgatggaattagttatttaactcttaagcagtagggaatttgttacctactgtattcttcaaatttttttccatgtgcataaattacttttaaaattagaggcagaaaaataaaatgaaattaacatttactgagcaccacagtactcttgctactattctagatgtttgggagcaggcatgtaagggaagggtataaaaataggacttatggtacaaaatagggtataaaagtagagtcttcc

SEQ ID NO: 407191 - DNA, 351 bp, Homo sapiens
tggaataatcaagtaaaacagggacatcttacaagacatatcaccctttctcaagccttgccacagtggttgcagaggggagatgcatgtctatcaaagaagaaaatgtaaaaattaccaagttttgacaagaaaatgaatatgaactttctacagcgcaactgttagatcaatagcaactacctaaaagtaattagcctcatgcaatgttaataactatttattttaatttctacatcactaagccatatttgaaaaatatatttgaaatgtaatatagtgaaaatacttgttaaaattaagttataaataatattgtggtaataagcaatgcctaaaccttagcagcat

SEQ ID NO: 407192 - DNA, 568 bp, Homo sapiens
cagcctttcactgtctcccacgtctctgcaccttgtaggatgtcctcatgtctcttcatctctgctcctgtgtcatactcattatatagcaaacattcagcaattattagaatggttgcttctatcgacaggtaggtgggtgaatggatggatgaatgggttagtgaatgttctactattatctctcagacagctgtttcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagtgaccttgcagtacatccacaaaaaatgagcacttttgtcctggggcagtggaacattcactgcagtgtatgtgtgcctatgtgtatgtgtgtgagagtggctgaaagaccctgatttgatatttttgataaaatacacctgggttagcatcctagatctaccttatttaaaa

SEQ ID NO: 407193 - DNA, 385 bp, Homo sapiens
gggcttcttaaactctaggtagtgaaggactagcttgttggtttgtttctaacttccatctgtcctgaatgaataattttgataatacaataaaaaatatattactagagaaataatcacacatttgaatgttgcagcaatgtcaaactgccataaacatttctaattgcttattctcaatattttttactgacctcgttgcaggtcagtagtggttcacagaccagcacaggtctgccaaccacactctgagaaactgttctaaggatcaccattcctaagagaaattccctgaataaagagttctttgatcaaataagtttgggagagcctgtaagctagaaagtgttgatgctcagtaacatattaaagctctgaaaagtcc

SEQ ID NO: 407194 - DNA, 442 bp, Homo sapiens
cttcagggtgattgggaacaaggtaagatttatgaatttcacaagcatgggcccattggtgtgctacacttgttgtgaaccaagttctctaatcaggagcaatgctgtgtggaataccatgacagagaataaagcattttcaaagtacacagaaggtttttgtggaaacactgtgcacatggaaggatcagatgtcaattccagtgagaaaagaagtgttgccctttccataatggaagtgttccaaataatcaatttttgtctcaaggaagctaggtagttcccccaaggaattatgccataccaggggctcagtgttagtctctgtgttggcaagttggactctctcagtggtggcagtagccagatctagtgggtagaaattcatgttgctgagcctatgaataacctccattcctttttttttttttttgagacagag

SEQ ID NO: 407195 - DNA, 277 bp, Homo sapiens
aagaaagattgggagattaacaaaaagagttacagtggttcaggtgagaggtgacctgaaagaagaatattatggtcaggatagagggaacaggtgggccctagcaatgcctgtggagttagataactggtaggatggggacattgcatatgactggaggttgcagtgggggaaggttaatgggaaggtcaaaggcgaactggaatcactgagagttttcttatatgtcagtctctgtacctactacctggtgacactgagccatcttgactaactc

SEQ ID NO: 407196 - DNA, 804 bp, Homo sapiens
gtgtcatagtgttcttttggagtattttggaagaccagaaatgtctcagaagggatataattatttatatcaaatcttaaagtattccttcttcaagtggacattctaactatttttctcatttatctttttgggttttgtcatattccacagagaataaaattataacttttctgatttatatgcttttcctactgtttcaaatttagcaggtatttcagggtagactgaaattacttatacgttgttttggaaatttctgtagctgccttacattttagtaggcactttacttgcttatgagcagattacttcaagaaagcagaagcttagattcccagagatgagcatttattttccctttgtgtgtaccaacactctaagaacaatacaagagcccccacttgtgcttctgaaaaacaagtggaaaaacttgtgggttgcatggaaagaacttcacaagtaaattacttgaggaatccacaaagcagtattgtgggtggcattgtcagaagagtgacagaatggtaatttaccagttattaccaatgtctagcaaaatttacaaactcttgcattttagacctctagacctttgttacctgcattttcttagcccaaaatatcttcattccccttctctgcctggctacagcctatgtggtcttctatgtctcagcttaagaattactggctgcagaaagccaccctcaacaccctcttctattcttgcatcaccctccatgcctcctactacagcatttatcacactgcattacagttgtcattgtatgtggctcatgt

SEQ ID NO: 407197 - DNA, 378 bp, Homo sapiens
taagagatggggtcttgctatgttgccaaggctgatctccaactcctggagctcaagcagtcctactgtttcaacctccagagtagcagggactacaggactgtgtctggcttttgctcattttttagttggtgatatggtttggctgtgtccctacccaaatcttatcttgaactgtagctcccaaaattcccacatgttgtgagagggacctggtgggaggtaatccaattatggggacgggtctttcctgtgacaatgaataagtctcatgagatctgatggttttatgaaggagagtttccctgcacaagttctcttctctcatctgctgccatgtgagacgtgcctttcaccttccaccatgataatgaggcc

SEQ ID NO: 407198 - DNA, 415 bp, Homo sapiens
ccaggatttcagcatcacaaactgggcaagttaagagaagggacagatacattttaagttttatgttaaagatttttttctaactgaagcaagatgaacccatttaggaggtctgtgataacaagcagaacactctggacaaatgtccctagtattttaagaagggctcaaatataaagcctgtgacatcacaaacaaaactttttcctgtgatctgagctatactctcaggtgctcacctcattctcctgccatcagggtgctcgatttacttacaatccactagaccaacctcatgtataaaatgaccatgagctccaggcatggtggctcgtgcctgtaatcccagcactttaggaggcctgggcaggtggatttgcttgtggagttcaagggcagcctgggcaccccatct

SEQ ID NO: 407199 - DNA, 739 bp, Homo sapiens
gccatgtgacaacagaggcggaaactggaggatgcactttggagatgagggaaagaactacaaaccaaggagtataggcagccactagaagctggaaaagatggaaatccattcttccttccgaatctctagaaagaatcagcctgccaacaacttgactttagctcagtgaaactgattttgtacttctggcttccagaactgtaagataatatatttgtattatttttaaccactcagtttgtgataacttgttacagcagcaatcaaaaatgaatgcagagagtcagaaacttttaaaaggtgaattaatgagtattgaagtcaaactggactatacgattctgctgactcggagtcaagttctctgtccatcacatcacatgatcaggatgtcagtcattgtggtcttgacccctctgatgaggtttacttgttgtgacaaggcccaaaggaagagggatttgggtagaatttgcttgacctatttctgtgtttttgtaagtttttgttttgttctgttttgtttttaaacaactggtttctttctgtgaaggaacatttattttttcaccccccagatgcctttctttgcaacttttgctgtcatttcatttggttgatttctatttcactcttgattcagtgttgtttctttcacaataagataaataaaatgatcagaaatcgagcaagactttccttttgttagttctttcttttgatgtccaaagaaaaa

SEQ ID NO: 407200 - DNA, 654 bp, Homo sapiens
tagtagagacagggtttcatcatgttggccaggatggtctcgatctcttgaccttgtgatatgcctgccttggcctcccaaagtgctgcaattacaggcgtgagccactgcacctggcctagctatattatttaacactaacaaattatttgtgaaacatctcacaagtgagtgaaataaaccaagtctgtctatgtatgctggggttgagaacctccttattataccaagctctctcctagctaagaaatcatgcccatcccagaggtctggccgtaataccatgagtggtgccaagggtttgctccttgaaaaggaaaagggtaaaaccccaagctctgtttcattcaagcccaaccaggtgaggcaaagaaagtgggagatcagccagttgctctaaactgtttaactctctcattttgtagcaaaagaaagatgagctgagagaatataagggacttacctagagtcacacatctgcatagcctaaaggacatcctgacaaacccaaaagtagatctttctgtgcccattgaatggcaatctcccaatattactctgtcctttcctcttttgccctatctcccaccaaaagtacatggtttctcttgtctgaatgtatagtagtgcagtcgctgttttcaatatctagaa

SEQ ID NO: 407201 - DNA, 408 bp, Homo sapiens
ctactgacattttaacctcactgtgtaccaaagtcaaactcatcatcttttctccaaagtcagtttctcttccaatttttccaacctagttcacaacactacaatttattcaatcctcaatcctgctgatggagtgacatctgtgaagagacacaaaggagatgagaaagtaagccctatgcgaatttgagaagagaacatttagggcagaaggaacattaaatgcaagacccagaggtagaaaatgcttggactatttgaggaacaacaacatggccagtgtggttggagtagaatgagttagggagaggttattaggtgatgaatttaaagaggctgcagaggcttgagatcattcaggggctttggcttttattctgactaagatgggaatctattgaagggttt

SEQ ID NO: 407202 - DNA, 441 bp, Homo sapiens
tgagactcaaaatcaagactttgtgcctgtgtacctcccatgatggtgtatatacttaacatttccttccctgtgaaattattatttttaacatatctgatagactgttgagaagttaatgtaataggaattgtctttctgaataccaaaattaaattcaattttagaccccaaatcttgtttgcagagtcctctgaaagttagactagggcccctgccttctgcagacaaccctcccagctcttcttttaccacttccatgatagacacttggacacttctaaagggctagagggtggttaagttaaactgcccacttgtgtcattttgagtaatgcagaataagttcctggtctcatttttttgtacactttttttttttttttttttgagacagagtcttcctctgtcgcccaggctggagtacagtggcatgatctc

SEQ ID NO: 407203 - DNA, 771 bp, Homo sapiens
tgaatctcagaaaaatgaagttacttatataatgtaaagtttcattgatagaatgataaagacctcttgtctaagtcttatctaacctcttttatttcttttttaatttttactttttctaggtcataagtcatgtcttggtaaagaaggagagttaaaagtcaataagcattacaaaaattgccattttgacatcagcaaatcaaatttctctatctaattaaaggaaaaccctttctcttatttctcttctcttttcctcttctcttcctcctcctctatttcccctctccttatccccttgtctccctcttctgctctttctctacttcctctttctctttttttgatatatttctatcatatattttcagaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacaaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattggtcaccctgaatggaagcacttgcaagggtttccgccaatgggtttagaccctggggggattcagccccaatattttggggct

SEQ ID NO: 407204 - DNA, 2713 bp, Homo sapiens
ggagactttaacatcagaaaaaggatggacttgttgcagttgctgtagcattcaaagtcaaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 407205 - DNA, 2659 bp, Homo sapiens
ggagactttaacatcagaaaaaggatggacttgttgcagttgctgtagcattcaaagtcaaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgttaagttgtatatttttcagaaattataaatattattaatttaaaatttgaa

SEQ ID NO: 407206 - DNA, 2671 bp, Homo sapiens
ggagactttaacatcagaaaaaggatggacttgttgcagttgctgtagcattcaaagtcaaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacaaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 407207 - DNA, 2662 bp, Homo sapiens
ttgaaaagtcaagcactttgtgtgtgtgtgtgtgtgtgtgtgtgtgtgtgtgtgtacatgaaagaaaatcagacagattgaccatctttgatggtaactcaaagggataaatagacatagttaacagataaaaaaacaacaggtgaaaccatgatatttcatgtcttgaccagattataagcactcttaggataaaagcaaggtgataacccactttgttcatggtgtattgaagtatctttcttagtggacactcccatttcaccccctctcatcacctgttctgaaatacatgctgggaagttgacaaacaagattctggtaatttggagaagacagcggttcaaataaaggagaaaatttctctgtatttctgggaaaactgaaaatattcagtagataagcaaaatgttcaatttcatgttgctcttatagttataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 407208 - DNA, 2728 bp, Homo sapiens
agcggacttcaggccatctcggcgtatacgtgcaagtcacaggggatgggatggcttggcttgggctcagagacctgacagtggcaatgtatggccacgttactgaatctacatgttgcaagagaaaaactagcagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggataattttgattatcctcagtaaggcttcacaacttcacctgctgctgtacaggttttcccatcagcatttcactgaagctgctctttctaagttataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 407209 - DNA, 2638 bp, Homo sapiens
agcggacttcaggccatctcggcgtatacgtgcaagtcacaggggatgggatggcttggcttgggctcagagacctgacagtggcaatgtatggccacgttactgaatctacatgttgcaagagaaaaactagcagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 407210 - DNA, 2659 bp, Homo sapiens
ggagactttaacatcagaaaaaggatggacttgttgcagttgctgtagcattcaaagtcaaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 407211 - DNA, 979 bp, Homo sapiens
tttattatttttttaaatacaaatctttcccattgggaacctttttggtgtgtggtatgtaactgatttttctaaatgttcagcacattcagggtttggggggttgtagtaagggtacttgtggagctctcaacagcaggactttaaaaatcttttctccagtgctctgcttttaacatgacttaaatattctctcagcctgtttcagttttcctgccattggcttatgctatcttctatgaggggagttagcaaactttttctataaaaagcccagtggtaaatattttaggttttgtgggccatatggtttctgctcttgtagcatgaaagcagtcatagacaatacataaatgagtgagtatggctgtgttccaacaaaactagttacagaaaaaggtagtgggctggatttggtttattggcggtagtttgccaatacctgctttatgacactgtactcttacaacttctgctcacctagtttctgcttcgtcatagtgggctttctcatagttatgcctctgattttcccttgtaacttcttagaataccttcttcacctctcatctttgctactgattacctgtttccatatttcacaattttaagtttccgagagcacaggcgatagctaaattaagatgctttgcatgttaccactattatgtactttgcttggctgtctaccctgttgcttcaatataaccaattccaaatagctgcattccttttgagggtctcttccttgccaatccagagttcattgcaagaaatggggtgatttggatcattttaaggaagtttatggaattcaactctagtgtggtatcattaatgtaattaagctcttctctccttatgtgcatcatgttggtcctactacagtttggtttcctcatactctgtcttcctctaacctcctggttactgaatacttagattttttttctcattcataacttgagcttttgcaact

SEQ ID NO: 407212 - DNA, 741 bp, Homo sapiens
tcgaacttctgacctcaagtgatccacttgcctcagcctcctaaagtgctaggattacaggcgtgagccaccgtgcccagctgcttttgacattttctttgggaggtttctggggtacaattagctgaaatctgaagtttggttttgcatggtcttgcccaagctggtggttggtcattgtggccttctgatctggtgatcctaagaaacattctgaaaacatacccaaaaacacataaaaggcgtaccttaccatttaaaggttctttcagtaaaggcctatgagtaatttttcatggagggagcccattcttacgaagttttaatggacaaacatatcattatcctttaaaatggtattattacgtggtcttttaatttttaaaaagctcatttttccccattatcaagataacatgttctagacagacaatttaggaaatgcatatgattatttttgttctaattttctgtaataccaccacatagagacagtagtttttaaaaactgtgtgatatttaatgtattgttttcatttcctttaagatgcaatttagagttttagccttgaactttagttttccttcctcttggagatttagtttgatgctaaagtgctatcttcttgtttcaacttttgcttaatttactccaacacttttagacagcaaattaggtaactttatactagtgttatctaacaatgttttgctaacttccattttaagatgttagctcac

SEQ ID NO: 407213 - DNA, 405 bp, Homo sapiens
aaactcagttattggaaactactgatgtacccatataacctgggtcaatcttctgatgctagccttggacctcaacatatatttatttctccccttgggacacagatcgataaggttaaagatgtccctttgcttcctcactgccaggaatattttggttgaaatatgaatatgtatattaacctcagtcacttttggcaaacttctttctacaggttatttgagagtttattatattattaattgtaaaggtatcagatatacatagaggagacattacacacgtgtgtgtgtgtgtgtgtgtgtgtataatacacatttactcctgtattcatagacgagaaaaacaaaaaccatgctaaccatgtcttcatttttggaatttgaacattatggaccaataaa

SEQ ID NO: 407214 - DNA, 339 bp, Homo sapiens
tttactttgctgaatggtttctttaaaacaactcatcttaatgtaaaatatcttcttgttctcactatctttttcttttttttccataaaatttcaaacatacaccaaagtagaaagaaggcaaaagtggtaacctatatttgtacacaccaaatttatacaattataatacatgacaatcttatttcagccattacttctgctcatccacgtatacccttggtactatttttaagcaaatagagaactcctttttaaccttttggtaataatgataccaacatttattgagcatttactatttatttacagggcatcatgatcatgataagaggtttg

SEQ ID NO: 407215 - DNA, 460 bp, Homo sapiens
  misc_feature (251)..(251): n is a, c, g, or t
  misc_feature (372)..(372): n is a, c, g, or t
  misc_feature (409)..(409): n is a, c, g, or t
  misc_feature (451)..(451): n is a, c, g, or t
atggatgagactcagtcatgttgagtgacaaaagccagacacaaaagaatacatactgtatggttcaatttttatgaaattgaagatgaaccagaatttatggtgataaaaaatacgatagcccagctaatttttgtatttttagtagagacagggtttcgtcatgtgggccaggctggtctcgaacttctgacctcaagtgatccacttgcctcagcctcctaaagtgctaggattacaggcgtgacacncgtgcccagctgcttttgacattttctttggggaggtttctgggggtacaattaggctggaaatctggaagtttgggtttttgcatgggtcttgccccaagctgggtgggttgggtcattntgggcctttctgattctgggtgatccccaaggaacantctggaaaacataccccaaaaacacattaaaagggcgttacnttacccttt

SEQ ID NO: 407216 - DNA, 377 bp, Homo sapiens
atttgtaagggtacctctgtagcttgtcttcctaaggttttgttttttgttctcgtagcccataggggtttaagtctgaccagcttaccctggcatttctttatttttctcagtggaattgtctacagttgagccaggagacattcctctttgggacatcctagtagaatggcatagtctgtcttctgagttgatagaagaggatggaagactcctttagtactctgagaaagactgatttcttttttcaggaccaggtttgccatttggcctatatacacccatattgcttcccactcttttcttccagtaccgaggtcaagccactgattgtattcttagaattaaaaaggcagtgtgataaggtgttttaggag

SEQ ID NO: 407217 - DNA, 439 bp, Homo sapiens
tctcttgtcattgactagaattgacattcactgagcaactgcttgcctgtctgtggatcaggccatgtgctggtcattatatattcattacctcattttgtcttcacaaaacccttcaagttatgaatataggtccagtggcatgggaaaaaagtagaagaggatatttcaggaggactgctcagggatcgaaaaaggtttaaaacccataaccaccaaatacaatacgtacatctgctttaggaacttgattcagtcaaccaaaatgcagaaagacattttttaaagacaatcagagagatacgaatgtggactgggtattagatgttaacaagaaattattgttggtgaggtgtggtaatgaaattgcagttatataagtagcaatattttttagataatatgccaagtatgtagggatgtaatgacctaaggtcta

SEQ ID NO: 407218 - DNA, 428 bp, Homo sapiens
gagagctagcaccatgagcttcaataccctgtgtgaattttcagcagaaaagcagtgagccaagcccagaagaccatgaatggaaaaagaatatgaagccacactgtaagttcagcctacagaaagcgtatcacagatattacatcaatggaagaggaataaagggttcagagggaaaacaggttacctgaggtacgtgcatcacctgaggtcaggagttcgagagcagcctggccaacatggtgaaaccccatctctattaaaaacacacacacacaaaattagctgggcgtggtggcgggcacctgtaatcccagctacttgggaggctgaggcaggagaactgcctgaacctgggaggcggaggttgtagtgagctgagacagtgccattgcactccagcctgcaacaagagtgaaactctgtct

SEQ ID NO: 407219 - DNA, 459 bp, Homo sapiens
aattaagtgaatattgtagttgctgccgagttgcactgttcagatgctgttgctacgtaaaattccactcctagaattactggtgaaaagtcattttattatgctcacaaattgtgtgggacaggaatttggatggagcacagtgatggctggggaaggagccagggagtggcagggagcttttcagctactggcctggaggttgacattggctgtcagctgtggcctcagctaggctctcggttggaacacctacactgtgtagtttctccctgtgggcacatttgacttcttcacaacctggcactgggttctaacaatgagccttccaagagagcaagagaagtgcatggcattttaatgattagtcttggaattcacatgatgtgtcttctgtcatacttcattggatgaagcagtaaccaaggtccatccagcttctatagaagggtacataga

SEQ ID NO: 407220 - DNA, 683 bp, Homo sapiens
gacaggctcttgctctgtcacccagactgaagtgcagtggtgtgatcatagctcaccgtagccctgaactcctgggctcaagcaatcctccctcagtctccagagtagctgagagtacaggtgcgtaccaccgtttccagttttgttttgttttgttttttatagtcagaatcttgctttgttgctcaggctggtctcaaactcctggctttaagcaatccgccagccttggcctcccaaggtgctgggacccccaggatgagacacgtgatcagcccttgcatttcttaatctgaatgtaacgccagtgaaaagagtaacagatgttaagaaaatggaattttagccctggctcttttatcaatttgcagatgacttttaagaacgaaccacagccttcagcctgttttcccaactgctaaaacaaagaaaatacctgtcctacattctcatcaatatgactgagaaaaaaaggtttggaatcagtacaacaaacacttggaagaaaaagtatacaagtgctatttttgtttttcttacacacttgtatatacatattaataaggcaaattcaagttttaaaaactttggtcttagtgaaatcagaagaatatattttcccccaagtttcagacacatatatacctcagaatgtggatgctacagaaaaaatattccaaaag

SEQ ID NO: 407221 - DNA, 411 bp, Homo sapiens
aaacattcctatgactttgtttccaaacttttctttggcagcgctgtgcgttccagaaagggtgggcaagaatgcgagggggtaaatcagaagaagtttcatattaagaagcctaagtgtgcccaaatgtgagtgggtcacacgagatgcactaagcgtctcagtcagctaataacaatcagctcatggcccacctggccctgctgtcgccccgaccttccagctgtgagcctacggcagctggggcaatggtgtacccaacctgctccttgctcacctctggcatggctgggtccgagctccagaacatggcatctctcctccctgcaccaccttccctgaggggtggggcctgcccaaggccttggactcatcctgacctgaggcattgttcaaggagtttgatcccag

SEQ ID NO: 407222 - DNA, 745 bp, Homo sapiens
tttttctccaatgaattatttcttcaggagtgctggtaattaaattagcaggaagactacttatatttagtgaatgtatattacacagagttggcaagacaaggctcaagctacatctcaaattaaaatagaaatgtatatgcaatagggaacttacttttcctttgtgagaagtaaggggaatctcgcatttcaatagaaaagtctgaataagagaactagaataacccaaaacagttcattttttttgtcggtaaaatttgagcatttgtgaatttaagtttttttatttttatttttttacactttcaggtattgtaaacctatgagtggttttacattcacctgggcaaataatctgttaatttaattaatttggaatgaaggatgaaaacctgacttttcagatgttgtctctaaaatgtctctctcagaggtactgcaagtatgaaggaggaatataatcattggctattatctcctccctcccacagagtaccttctgtcatagggtaactcctctgcagtggttgtcatatcttctcttctcgagggtcgctgctctgttccctcctctccaggtcagggtcatcgggttggcggcgtcatcggggcatggagtcacctgggtctgctcctcagcttgtccgtcaggttcgggagcatctgtcctggcttctggttcttttcagaacttttaccacgctgagcacttggtctctggagcttgagctgtttggctgtg

SEQ ID NO: 407223 - DNA, 770 bp, Homo sapiens
tttgagatggagtctcactctgttgcccaggctggagtgcagtggtgcgatcttggctcactgcaacctccacctcctgggttcaagcgagtctcctgcctcagcctcctgaatagctgggattacaggcatgtgctaccacacctggctgacttttgtatttttagtagagatggctttcaccatgttggttaggctggtctcgaactcctgatctcatgatccacccacatcggcctcccaaagcgctgggattacagacgtgagccaccgtgcccggccgagaaatctaattttttaatagttcatcctatccccactgactgtaataccaaccccaacatttattaacttcccatatatgatgaatcattctgcattctgttctgtttccacacttgttacttggggaagaaaaaaaaagaagaaaagaaatttttatctgagaaatatgagcccctttacattatcaggcccagagaggcattgaaatagaacagcaatcatgtcacgcccccttgagctaaataattattatctcttgaagccagctgttatgtgggatgccaggtaaccataaaatgccatatatcctgtacttcataatatgtagccaatcactaactaatgttatttctgtaagccagtgaacattccttcctttccttcctttctttcccttccttcccttctttcccttccttttctttccccttcccccttccctcctttcccctcccctcccctcaacaggatcttgctttgtcacc

SEQ ID NO: 407224 - DNA, 681 bp, Homo sapiens
agcctgtgtggtcaggcatggtgaactgggcatgccagtgactcccccagttcagactctctgttagaggcctactcttgcttgtgggggagcctgccttatgttgctttgagttttaagccccatgtttacctactagcttgaaaaacagagctgcccagacataatcaacccttgacactcaacccagtctggcgacaaagcgattatagtttttaaattattagtagtattttcatttcctcacattgcttataccgctcaaacttatgaccagttccgagctctggagagaagccattttgcaaagggatgtcccctcctgctcctggatatctgagtattaaaaatttgcttgggttgtgcatggtggctcatgcctgtaatcccagcactttggtaggcctaggcaggattgcctgacctcaggagtttgagatcagcttgggcaacgtggtgaaactccatctctactaaaaataaaaaaataaaaaaagagatacttgggtggatctcaggcctggtcacttcctggttgtgtgttggcactgttgatgtttggggataattgtttttggggggagtgggccaccttgtgcattgtaggacatttagtatccctggcatctccccactagatgccagtagcaccttcttcccttgatgtgacaatcaaaaatg

SEQ ID NO: 407225 - DNA, 712 bp, Homo sapiens
cccgaactgctggatcactgtgtattttaacaggacccccaggtgaactctaagtgtgttcaagtttgagaaacatggatcttgagcacagttgtatctctctgaacttttttgagagaattaagtgaagccattagtagggtttcctgcatagacacatattcaacacctttagtaaaaaacaaaaagcccgcttcttaaaagaatatgctttactttgaaagtttgcatttatgctatcttgtctatttaatgctatataatttcagacataatatagtaactctacaagacctccttccctgtataaaaagacgcactataagtttttgtagtcatctttgaggtctgtctgtagtgtgctttattaaaagcgagcaaatactgaaggatcccatttaagtatgtggtctgcggtggagtctaatttgtaccactaggcaaaggtcacacagaggagctcgttaatgcacttactccgggatgaaatcaatctccatacttcaccatattgatctgatagctcattggcgcttccctccgtgaactggttagctcacgtgtgaatggagagagatagatagctttctgggcctgagaattctagctggggtgccatccagggcaaaaggtggatgtttttacatcctcatttgggtggcccttttggtttctggtgttaggctcttgtgctggtatatcagttagtcag

SEQ ID NO: 407226 - DNA, 367 bp, Homo sapiens
atctaggaaactaaaaaatcagaaaagttagtttgattttatcagatacatctgctacatctaatgagatgatcatatagtttttttcctcccataaactgtgaatataatgaatcacattaattgatttttttaaatgttaaaccaatctccatttctgggataaattcaacttagtcatgttgtattagccttttgtatatcttatatctataatactgaatgagattatcatactctttacatgtatttgaagccatgtcattaagtgcatacaatttttattaaatttttaattgacaaataattgtatttatttatggggtacgatgtagtgttttgatatatgtttacattgtagagtgac

SEQ ID NO: 407227 - DNA, 350 bp, Homo sapiens
taaataatttctaccataaatgaaaattttcagaagttagaaaaagagaagccccccagttcattatgtaagattataacttaaaatcccaataaggacagaacaaggaaaaatgtgtatgtatattcatctcacatataaatagaatgttttctatttatagaaataaaaaatgtcttacaaactcacaaattaagtagttatttttttaaaaatagagacatacagtttatcctaggaatgtaagtatggttcatcagaaagatgaatataatgccagattaacaaccgattggctgggcgtattggcttacgcctgtaatcccagcactttgggaggccaaggccgg

SEQ ID NO: 407228 - DNA, 474 bp, Homo sapiens
gtgcagagtcttatcccagaaattaaaccaactgaccatactcaacttataccacagttaaaggaacaccattccttcaagatgaaaaagaatcaacaagaaatctggcaattcaaaaagtaagaatgtaccttaaccttcaaatgggtgcatttgagctctccagcgatggttcttaaccacattggaatgactaaaatgacagacaggcaattcggaatctggatggcaagaaagctcattgagattcaggaaagtgctgaaacacaatttaaggaattcaataattccagtagaatgatccaaaagctgaaagacataatagccattaaaaaaacactacttctggaattaaaaaaaatactacatggatttgataatacatccagacctttagcaacagaacataccaaagagagaaaagaatctcagagcttaaaaaccagtttttataatcaactccatcagacaaaa

SEQ ID NO: 407229 - DNA, 977 bp, Homo sapiens
gtatggtacctctcataggttttctgagtaactgagaaaaagcatttgtttattttgttagtattttatttttaaagtttaagttaaattttatattttattttaattacctgtcactgactttaagtccagtattttgctagtatttttaaaccactgtttctgctcttctttcctacccacatacctttttgttttcctctctcctaatctgtctttacttggtagtacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttgga

SEQ ID NO: 407230 - DNA, 1166 bp, Homo sapiens
gtatggtacctctcataggttttctgagtaactgagaaaaagcatttgtttattttgttagtattttatttttaaagtttaagttaaattttatattttattttaattacctgtcactgactttaagtccagtattttgctagtatttttaaaccactgtttctgctcttctttcctacccacatacctttttgttttcctctctcctaatctgtctttacttggtagtacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttggaaaaaaaaaaaaacaccacgtagtttggcctgctttattctccctaggcctgtattctttgttttaggatcacttcaatttattggagtaatacccccatttttttctttatacaaagcagtttatttctctcccagttaaaagaattccgacaatagacagccccaggcaggaatggcaactccacaaa

SEQ ID NO: 407231 - DNA, 2016 bp, Homo sapiens
agcgggggagtggccgggagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcggaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctgggtgaggtgtactggaaaaaaggggatgttgcagctgcccacacctgcttctcaggagccctcacccattgcaggaacaaagtctccttgcaaaacctgtcaatggtgcttcgtcagctgcggactgacactgaagatgaacattctcaccatgtcatggacagtgtccgacaggctaagttggctgttcagatggatgtccatgatggccgctcctggtatattcttgggaattcatatctttccctttacttctctactggccagaaccctaagatctcccagcaagccctcagtgcctatgcccaagcagagaaagttgacagaaaagcgtctagcaatcctgaccttcatctgaacagggcgacgttgcataaatatgaagagagttatggggaggccctggagggcttctctcgggctgcagccctggaccctgcctggccagagccccggcaacgagagcaacaacttctggaattcctggatagattaaccagcctccttgagagtaagggaaaggtgaagaccaaaaagctgcagagcatgctgggaagcttgcgcccagcccatctaggcccttgcagtgatgggcactatcagtcagcctctgggcagaaagtgaccctggagctcaagccactgagtacgcttcagcctggggtgaacagcggtgccgtcatcctgggaaaggtggtatttagcctcaccacagaggagaaagtcccctttacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttggaaaaaaaaaaaaacaccacgtagtttggcctgctttattctccctaggcctgtattctttgttttaggatcacttcaatttattggagtaatacccccatttttttctttatacaaagcagtttatttctctcccagttaaaagaattccgacaatagacagccccaggcaggaatggcaactccacaaa

SEQ ID NO: 407232 - DNA, 849 bp, Homo sapiens
agcgggggagtggccgggagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcggaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctgggtgaggtgtactggaaaaaaggggatgttgcagctgcccacacctgcttctcaggagccctcacccatgtgagctgccccctatccctttggaaagcagagatgggaaggatgaatttctttggttctatgagtttccctaggacatgaataccagagtagaactgaaattgaactaggacagaatcaggagggaggaaaggtcagagagcagacctgaatgaggaaaatagaggcaggggcctgggaaaggaagatgatgatgggatcaggttcagggggagaaaggaagtgaagaaaagctagcagctaagctgatccctgtggatgggggttgaagatacagatggcagcaagaatttagatgaaaaaattagggctgggtgtggtagcttacacctgtaatcctagcactttgagaggccgaggcaggaggatcacttgagctcaggagtttgagaccagcctaggcaacatggtgagaccttgtctctacaaaaaa

SEQ ID NO: 407233 - DNA, 1827 bp, Homo sapiens
agcgggggagtggccgggagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcggaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctgggtgaggtgtactggaaaaaaggggatgttgcagctgcccacacctgcttctcaggagccctcacccattgcaggaacaaagtctccttgcaaaacctgtcaatggtgcttcgtcagctgcggactgacactgaagatgaacattctcaccatgtcatggacagtgtccgacaggctaagttggctgttcagatggatgtccatgatggccgctcctggtatattcttgggaattcatatctttccctttacttctctactggccagaaccctaagatctcccagcaagccctcagtgcctatgcccaagcagagaaagttgacagaaaagcgtctagcaatcctgaccttcatctgaacagggcgacgttgcataaatatgaagagagttatggggaggccctggagggcttctctcgggctgcagccctggaccctgcctggccagagccccggcaacgagagcaacaacttctggaattcctggatagattaaccagcctccttgagagtaagggaaaggtgaagaccaaaaagctgcagagcatgctgggaagcttgcgcccagcccatctaggcccttgcagtgatgggcactatcagtcagcctctgggcagaaagtgaccctggagctcaagccactgagtacgcttcagcctggggtgaacagcggtgccgtcatcctgggaaaggtggtatttagcctcaccacagaggagaaagtcccctttacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttgga

SEQ ID NO: 407234 - DNA, 1194 bp, Homo sapiens
agcgggggagtggccgggagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcggaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagtatcagtcagcctctgggcagaaagtgaccctggagctcaagccactgagtacgcttcagcctggggtgaacagcggtgccgtcatcctgggaaaggtggtatttagcctcaccacagaggagaaagtcccctttacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttgga

SEQ ID NO: 407235 - DNA, 406 bp, Homo sapiens
aatactttcttgttttcattctttttttccccattctttctgcatatctgctctccccgtctccagttgttttgaatcatggctgagcattttatcacctgatgagtttttaaagctctgtaagctcagaccaagccccagactaatacatcagaatctctaggggtgggacctggtattgggtaagtttttaaactccacaggtgattacatttggcagccaaggttgggacccatggtttcagatgtagtaaccacatcaattaacttagtacctcttaagaaggttgcttattagaataacctgggagattttctccacactgttccctcccttccacttcccttattaatttagtgagccagtgttaactgatgggaatatacacatacccttggatatgtt

SEQ ID NO: 407236 - DNA, 808 bp, Homo sapiens
ctagctctccacctgctcgctatcatgaaaagcacttcctcttcccttttgctttatctcttgtcttcctccacattaatccagagcacatacacaaacatgtacataccttctcccaaataagtacatacctgcatctatataagtgtcacgtcttcaaccttacctctccccctagacctaactcactttttaaaaaaaattcccacagttacagcatgtatcacttaatttattctctacctatggtttgtattgttttgtgttgtatatcttatgcttatatggttttatatgggctgacttaccttcctggttgtaagcttcttgagatcagggatttaattttttctcatgtatctctcgtatagcccttaccacgttggtaaatatgtagtaaatgcttattaagtcttaaaataagcctgtcctgtggagcagaaacgttcctcaggaagtgtcttatcgagtgttcccattttacaaaagagaaaattggaacagtgaagtgacccattttctttatgacataactggtgagtagcaagccctgaaccagaacctagggctcctgactcttagttcagtgtgcctgttcccaggcagccttgaccacgctgatgctcagggaaacactgccacgagaacatggcatttactgctgctcacgtggacagtggtgatatccatgccctgaacaacagcctgaagttcttcccagcattccccatttttcatcttgcctccttaactttataaaaccctctctattcaggaactagggaatgaatgagagtcctctctcatg

SEQ ID NO: 407237 - DNA, 358 bp, Homo sapiens
tcccttcacccgcggctgcctcctgcccccatgactacagtgtgatgctgtctgggaagctgaatgtcatcttccctgggcttacctgccaggctcctctcatccacatcttccagcctctagccacatggacccctccggaaagcatgtgtgtgtggggggtatgtgtgaacatttttcatgcttgatgtgagccggaagaaaaatgagcttctctatttgataagtgtggacctgcccacagcactaaatttggttctgccgtcaccggcgccatgaagcagcagcctggtttagaggcttgcctttggtttcaaataatttctccaggctcatgttacatatgacccattcacag

SEQ ID NO: 407238 - DNA, 1877 bp, Homo sapiens
atcataacctgcccacaagttctacgcacctgtgactttgggggtcaaattatatactcttcaaattgacttaagtacacaccgcttagatttcatgcgtttcaaatttagactaagagaaagatgctctagaatttaaccaggttttttaaatcagtaatttaagattttctaaccatttgaacaaattttacttacatgtatgcacatgtcatttttcgtgtttctatttttatgttctcaaaggtaggataagggaaggaaggaggaaacagcccatttggggttcaagagctagctctgctaagggcttgtaagctatttctattctgccctttggtctttttcttgtttgtcttgtctttatttttaaatgaaattcttgaagctatgtattgaattttctagtatagaggatgtgacttccacctccaaattccatttaactgattcttttaaaagaaagataggcgtatatacaccacgccaaaataataataaggtacctatgtgagaattgcaaattataccccagggtagcatttaggcagcgtcggcaaaaagtgagttaataaatcagaagctacatattaaaaaaaaaatcagtcaatccgtcgtgtgtttaattcttgcctaaagtaaatggagatattgttttgctttggtaaccagcaatttttaatttttttttattgcccgcaaattgagattgttttgttaaaatctgttgatctagcagcaagtagaattattcaactggaatcttgtattctattcagagcttaattttccgttaaggaaaaaaatgagcttcagtttgtgttgtgatgtgtataatttgcatgctgaatcacaacatgcttggagagattgtagagactctttggtaaataatctaacctttacaatttccgtttatatgttaacatttttctataatatgagtgcctttccaatgcacagatattttttatggctgtaatttctctgtaaaaataatttttaagcatacattttattctttttttgcaacaaccgagatttttccaagattgttctgtttcccctcgccctcctagctcccgcccccgtcacttcggcgcttgtattttctaattattcatgggtgccatgttgagtgtttgtaatttgaccaccacaggtaagcttcctgtttacttgaacactcagcctcatctccggtgaatgaagggaaaagcacagatgggtttctcccaggcacagctcactccaaaggtgtcttcatagagccaacccagcctttctcaagggagcatttccccacttaatgtgtttatcagcatctttcttccgccaagaattcaagagcattttcaaaattgatagattttggtgcagttttgcaagtttccgtggaaggctgtctcccgcttctgggatccacccccatgtcgggaccagatcggctgcagggagtcatgtttatgaaatgttggtggttttttttttttttcattcatactagaagtgtttttataacgaaaatctgcactttacaactctgcaggccatgcatgcaatggtgatttacagccttgtttacgtgtaattcctccaggtgatttatcccaatttatgcaaagatcctattttaaacagacacggagaagtggtaaccgtttcctaacagcagcaagaatgccccttccgtttgcctggtgaaaagaactgacattaacagcagcttggaggcttcgaggaggtggggacgtggcctgagctcgggacgggggcccagtgcgggttgtcggagcgtggctgcccggcgatgtctctgtatttatcaataaatctcccggttgctctgggaagcacttatgtcctgttccattatt

SEQ ID NO: 407239 - DNA, 2131 bp, Homo sapiens
tgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagca

SEQ ID NO: 407240 - DNA, 415 bp, Homo sapiens
  misc_feature (393)..(393): n is a, c, g, or t
tgaagtactaaatacattgtcagttacaattaaatcagagtggtttgacaaggattttttaaattcagtggcaagtgatacaactatagtatttttaattgtgctatgtgttttaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaaaaaanaaaaaaaaaaaaaatttgtggg

SEQ ID NO: 407241 - DNA, 2012 bp, Homo sapiens
tgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagca

SEQ ID NO: 407242 - DNA, 2204 bp, Homo sapiens
tgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcattttgtatatgttttgatttagtacccttgcctttttcatcaaaggaattttcaaatcattcactctaacatt

SEQ ID NO: 407243 - DNA, 1188 bp, Homo sapiens
  misc_feature (1166)..(1166): n is a, c, g, or t
tgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggaccttttgtggacactataagtagcaaaaaaaaaaaaanaaaaaaaaaaaaaatttgtggg

SEQ ID NO: 407244 - DNA, 984 bp, Homo sapiens
tgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggttagtaataaaatttttggtagtattaaaaatactttcatgtttttaatcacagtgttggaaataactatcagttgctactattttgct

SEQ ID NO: 407245 - DNA, 2300 bp, Homo sapiens
tgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccggactaaatcattttgctactttaaaaaaatcacgaaagtacattatttgaagtttggagaagaaagggatttggtaacaaaggacagccatttccattttaagcagctaaacagcaggagagatttctgtaagaaggtaccagctcagattccattgttcatcattttgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagca

SEQ ID NO: 407246 - DNA, 1714 bp, Homo sapiens
gtcgacccattggaataatgaaataacaaagtacttttagtaacaaatttcatccacatatcataaataaccacaggctattttgactccttatagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagca

SEQ ID NO: 407247 - DNA, 1353 bp, Homo sapiens
tgaagtactaaatacattgtcagttacaattaaatcagagtggtttgacaaggattttttaaattcagtggcaagtgatacaactatagtatttttaattgtgctatgtgttttaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagca

SEQ ID NO: 407248 - DNA, 883 bp, Homo sapiens
caaggtgatgatgagaatagatctgcctgttttctaaaaactctccccactgtggtatctccaccaggcttttttatttcttttgtgaaattaagatctctgagcaaggactaatagaacaggtatggagaagagaaatgtgtctgccatattagtctagatgtcctcaaatgtctggaagggtagatggagaacttacatatttgtttattctaagacatcgtaagagacacagagcacttatattttgttctctttctttcttttttggagagggagtcttgctctgtcgtccaggctgtagtgcagtggcatgagctcagctcactgcaacctccacattcagggttcaagcaagtctcctgcctcagcctcctgagcagctgggattacaggtgtgtgctaccacgcccggctaatttttgtattttttagtagagatgggatttcaccatgttagccaggctggtctcgaactcctgacctcaacaattagtgaataagggtgtctgctctggtatctggctggcctggttacaaattccagcttgatcactttttagcagtgtgactataggaaaatcatgtagcctttctgtctctcggtttttccttaggaaaatagggatgctgataataccttgctcagggggttgtccaaagctgtgttgtgcagtatggcagccaccaccatatggggccaccaaacacttgcaatgtgctgcttggaattgagatgcgctgcaaacgcaaagtacgtgctggatttcaaagacttagtacaaaaagaaaaaagaacgcaaaacatctcattaataatttttgtattgattccatattgaaatatattgcatcaaataaaatatatctttaacattgaaat

SEQ ID NO: 407249 - DNA, 431 bp, Homo sapiens
ctatttttagacttttctttttagtaggaggctaaagtagcttaagctattaaggtttgttatgcttatgtctgcaggaagaagtagctaaaaacttgttagctgaatttaacttgggatgtgatgttcaccaaactgagcatgtgtatcgagtctatgtggccacgtttcttgggtttggtggcaatgctgtcctctgtcagagtactcaggatctcagtctagagagaatctagaaggagtgcctgggtactctgacagaggacagcagcagataaagtgttttttccatgacaaaactaccaagttccaagaccaaaaggtacacatagacctttcttacagacttagggcacaaaactgaaattcaccaacatgagagctgctgcctaacatgtacactggcttttgagaatgccttcttcttcttc

SEQ ID NO: 407250 - DNA, 5831 bp, Homo sapiens
  misc_feature (3592)..(3592): n is a, c, g, or t
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtgatccagctcacagctccacgaagactcaaaaggaaaagccatttttgcctcagggtttctcctctttattttcctgtggttttgttttttctttcccttttttgttcctccaaacaaaaacaaaatgcaggccgagcgcggtggctcacgcctgtaatcccagcactttgggaggccgaggcgggcggatcatgaggtcaggagatcgagaccatcctggctaacacggtgaaaccccgtctctactaaaaatacaaaaaattagctgggtgtggtggcgggcgcccgtagtcccagctactcaggaggctgaggcaggagaatggcatgaacctgggaggcagagcttgcagtgagccgagatcacaccactgcactccagcctgggcgacagagtgagactccgtctcaaaaaaaaaaaaaatgcattgtttataagccctgctgtctagaagtattgcgtttagccattttgagtacagcattaaattgaggagtggggaagagggaaattcacttgatttttgctgcacaggatatctgccaaaaataaatgagatttctggggtttctctaaggaatgttaaatttaaacacatgcactttgatactggagggaggtggaaagatgcattctgtcagtggagaggggactgaatagtgatgctttcatagaaccaaaaaacttactgcctgaaatgataatcctcttttttctctatcttgaaagctctaacctgaagagggtgatttttttttttatttattgttcaggtctgttactgtatatgttttctttgcaaatttaaattttttaaaccatttatatccaaaacagagaaacatgggcaccaggagataaccatttataaaagtgatagtgaactatcgactacagctttgtgcgagtgtgtgaaaaatcccaagaaaccagcgtgaggggaggcaatgctggttctttaaaaacacacacttcagaatttactggtacattttatttagaaaaatcctcgttactgttatcttttcctgaccgcaggtaattacgctccttattccatatttcagtggcattagaacactgtggttttgaaagaattggaaattcctagtttcaccagtttcggttttattggaactagagcacatgcccacttcttgctcagtattcctcagtgtttctgcttaatcgtgcctcagtttcttccagcttccaattggtgtttcccccaccccccttaattaaaagtcatctcagcttttaatcgtactgggagaccccatgcacagcctgccgagtcctcttcctaaccgcattgactgaggctgttgctggcagcaccactgtaaatccagaagggaagagtctgcatccaatacaggaaataaattcacattttgaaggaaaaaattcgacaatttaagccaaaatctaaaaaggacaattggattggcatatgtgagattggtgttttttcacctatttatttagttgagaagtttggggaattctcgtacagttttnttaggtggagtttgttttgtgcgagtgtctgtgtgtgctgttccctaactccagaacagttaaattcctgtagttggtagcagattagtacccagaagtggggttgttgctataacagataactgaggatattataaaagtggctttggaactaggtactgggcagaggctgggagagtttggagaaacaggagagaaaaggcctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttggccacctgcctgcgacacttcctggaggagccatggattattggtggaggctgcagggagctggcgatggagccactggtgtcagcagcagagagggaagaaaggaaaggaaggggccacaaatggttgaagtgggcaggtgggcacccagggagttaggggaccccgccttccagctctgggcatagaagagttagtcacatacctgaggatcctgaaacaagggctgagaaaacctcattgctccagctgagaggtagtagtggatttgccatttttaaacagttgcctaagaaaaaacgttgaagaatatgcagcagacactatatgtggcctgtaaagcctagaatatttactaaaatatttacagaaaaagtttgctggtccttgtgagaacaatgcagttcaaaaaaggatacagacagaagcatcctcttaaatcaggaatgtagtttccatttgtgggcacgaaaagatggacaagagaagtaaccaaacttcaatcttaaaatatttgttgcaccagaatttcacttcggatttttccgtctagattattttcaagatgagttttgaaacaaaccaagaaacctgcccctcacccaaaattgtttaaaaagagaccactcaagggagttcattatgccgtatggagatgtctgcagtcgcagcaaatcacattccagagaaggtctcgcgtaggtgaagacagccaggtgctttctctaagagatacagggtgggtgagagacaagccagggaggatcttaattcaagagaagaattcataccaagagctgaccaagaaggcagtaaattctgtgtacttgtagcagaagaaattggactaggaacttgcccaaagctttatcaaagaaaagcattgtgttcaatcttggtagaaacatgccagcaataagtgcttatgttccatagccatatcatgggcttctcacttttaaacctcctccaggggatgttctcagacatttcacaatccctctggggacattacagtagaagagaaacacatggaactgtaccagtgctttttgcccatgttcatcctaagctccggctttaggcagtgctttctgacctgggcggagtgaagacgctgctggtggctgaggccagtaacatggggcccctgcccagccaccctgaaggctgggtaggtccctcttttcaccaccagttttccacacctgtgtactctagattaacaaactctggataaacagatatttacattttaaactcaggcctacacagagtagttttccttataaggagcatgtatcacttagcaagaaactaaaaatggcaaatgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcatcatc

SEQ ID NO: 407251 - DNA, 5855 bp, Homo sapiens
  misc_feature (3616)..(3616): n is a, c, g, or t
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgtaagctttgcgtcctcacagcaggaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtgatccagctcacagctccacgaagactcaaaaggaaaagccatttttgcctcagggtttctcctctttattttcctgtggttttgttttttctttcccttttttgttcctccaaacaaaaacaaaatgcaggccgagcgcggtggctcacgcctgtaatcccagcactttgggaggccgaggcgggcggatcatgaggtcaggagatcgagaccatcctggctaacacggtgaaaccccgtctctactaaaaatacaaaaaattagctgggtgtggtggcgggcgcccgtagtcccagctactcaggaggctgaggcaggagaatggcatgaacctgggaggcagagcttgcagtgagccgagatcacaccactgcactccagcctgggcgacagagtgagactccgtctcaaaaaaaaaaaaaatgcattgtttataagccctgctgtctagaagtattgcgtttagccattttgagtacagcattaaattgaggagtggggaagagggaaattcacttgatttttgctgcacaggatatctgccaaaaataaatgagatttctggggtttctctaaggaatgttaaatttaaacacatgcactttgatactggagggaggtggaaagatgcattctgtcagtggagaggggactgaatagtgatgctttcatagaaccaaaaaacttactgcctgaaatgataatcctcttttttctctatcttgaaagctctaacctgaagagggtgatttttttttttatttattgttcaggtctgttactgtatatgttttctttgcaaatttaaattttttaaaccatttatatccaaaacagagaaacatgggcaccaggagataaccatttataaaagtgatagtgaactatcgactacagctttgtgcgagtgtgtgaaaaatcccaagaaaccagcgtgaggggaggcaatgctggttctttaaaaacacacacttcagaatttactggtacattttatttagaaaaatcctcgttactgttatcttttcctgaccgcaggtaattacgctccttattccatatttcagtggcattagaacactgtggttttgaaagaattggaaattcctagtttcaccagtttcggttttattggaactagagcacatgcccacttcttgctcagtattcctcagtgtttctgcttaatcgtgcctcagtttcttccagcttccaattggtgtttcccccaccccccttaattaaaagtcatctcagcttttaatcgtactgggagaccccatgcacagcctgccgagtcctcttcctaaccgcattgactgaggctgttgctggcagcaccactgtaaatccagaagggaagagtctgcatccaatacaggaaataaattcacattttgaaggaaaaaattcgacaatttaagccaaaatctaaaaaggacaattggattggcatatgtgagattggtgttttttcacctatttatttagttgagaagtttggggaattctcgtacagttttnttaggtggagtttgttttgtgcgagtgtctgtgtgtgctgttccctaactccagaacagttaaattcctgtagttggtagcagattagtacccagaagtggggttgttgctataacagataactgaggatattataaaagtggctttggaactaggtactgggcagaggctgggagagtttggagaaacaggagagaaaaggcctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttggccacctgcctgcgacacttcctggaggagccatggattattggtggaggctgcagggagctggcgatggagccactggtgtcagcagcagagagggaagaaaggaaaggaaggggccacaaatggttgaagtgggcaggtgggcacccagggagttaggggaccccgccttccagctctgggcatagaagagttagtcacatacctgaggatcctgaaacaagggctgagaaaacctcattgctccagctgagaggtagtagtggatttgccatttttaaacagttgcctaagaaaaaacgttgaagaatatgcagcagacactatatgtggcctgtaaagcctagaatatttactaaaatatttacagaaaaagtttgctggtccttgtgagaacaatgcagttcaaaaaaggatacagacagaagcatcctcttaaatcaggaatgtagtttccatttgtgggcacgaaaagatggacaagagaagtaaccaaacttcaatcttaaaatatttgttgcaccagaatttcacttcggatttttccgtctagattattttcaagatgagttttgaaacaaaccaagaaacctgcccctcacccaaaattgtttaaaaagagaccactcaagggagttcattatgccgtatggagatgtctgcagtcgcagcaaatcacattccagagaaggtctcgcgtaggtgaagacagccaggtgctttctctaagagatacagggtgggtgagagacaagccagggaggatcttaattcaagagaagaattcataccaagagctgaccaagaaggcagtaaattctgtgtacttgtagcagaagaaattggactaggaacttgcccaaagctttatcaaagaaaagcattgtgttcaatcttggtagaaacatgccagcaataagtgcttatgttccatagccatatcatgggcttctcacttttaaacctcctccaggggatgttctcagacatttcacaatccctctggggacattacagtagaagagaaacacatggaactgtaccagtgctttttgcccatgttcatcctaagctccggctttaggcagtgctttctgacctgggcggagtgaagacgctgctggtggctgaggccagtaacatggggcccctgcccagccaccctgaaggctgggtaggtccctcttttcaccaccagttttccacacctgtgtactctagattaacaaactctggataaacagatatttacattttaaactcaggcctacacagagtagttttccttataaggagcatgtatcacttagcaagaaactaaaaatggcaaatgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcatcatc

SEQ ID NO: 407252 - DNA, 2709 bp, Homo sapiens
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgtaagctttgcgtcctcacagcaggaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtgatccagctcacagctccacgaagactcaaaaggaaaagccatttttgcctcagggtttctcctctttattttcctgtggttttgttttttctttcccttttttgttcctccaaacaaaaacaaaatgcaggccgagcgcggtggctcacgcctgtaatcccagcactttgggaggccgaggcgggcggatcatgaggtcaggagatcgagaccatcctggctaacacggtgaaaccccgtctctactaaaaatacaaaaaattagctgggtgtggtggcgggcgcccgtagtcccagctactcaggaggctgaggcaggagaatggcatgaacctgggaggcagagcttgcagtgagccgagatcacaccactgcactccagcctgggcgacagagtgagactccgtctcaaaaaaaaaaaaaatgcattgtttataagccctgctgtctagaagtattgcgtttagccattttgagtacagcattaaattgaggagtggggaagagggaaattcacttgatttttgctgcacaggatatctgccaaaaataaatgagatttctggggtttctctacaacaaaacaaaaaaacacaacaaacaaaacaaaaaaaacac

SEQ ID NO: 407253 - DNA, 5313 bp, Homo sapiens
  misc_feature (3074)..(3074): n is a, c, g, or t
caaatcggccgagctcgaattcgcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtgatccagctcacagctccacgaagactcaaaaggaaaagccatttttgcctcagggtttctcctctttattttcctgtggttttgttttttctttcccttttttgttcctccaaacaaaaacaaaatgcaggccgagcgcggtggctcacgcctgtaatcccagcactttgggaggccgaggcgggcggatcatgaggtcaggagatcgagaccatcctggctaacacggtgaaaccccgtctctactaaaaatacaaaaaattagctgggtgtggtggcgggcgcccgtagtcccagctactcaggaggctgaggcaggagaatggcatgaacctgggaggcagagcttgcagtgagccgagatcacaccactgcactccagcctgggcgacagagtgagactccgtctcaaaaaaaaaaaaaatgcattgtttataagccctgctgtctagaagtattgcgtttagccattttgagtacagcattaaattgaggagtggggaagagggaaattcacttgatttttgctgcacaggatatctgccaaaaataaatgagatttctggggtttctctaaggaatgttaaatttaaacacatgcactttgatactggagggaggtggaaagatgcattctgtcagtggagaggggactgaatagtgatgctttcatagaaccaaaaaacttactgcctgaaatgataatcctcttttttctctatcttgaaagctctaacctgaagagggtgatttttttttttatttattgttcaggtctgttactgtatatgttttctttgcaaatttaaattttttaaaccatttatatccaaaacagagaaacatgggcaccaggagataaccatttataaaagtgatagtgaactatcgactacagctttgtgcgagtgtgtgaaaaatcccaagaaaccagcgtgaggggaggcaatgctggttctttaaaaacacacacttcagaatttactggtacattttatttagaaaaatcctcgttactgttatcttttcctgaccgcaggtaattacgctccttattccatatttcagtggcattagaacactgtggttttgaaagaattggaaattcctagtttcaccagtttcggttttattggaactagagcacatgcccacttcttgctcagtattcctcagtgtttctgcttaatcgtgcctcagtttcttccagcttccaattggtgtttcccccaccccccttaattaaaagtcatctcagcttttaatcgtactgggagaccccatgcacagcctgccgagtcctcttcctaaccgcattgactgaggctgttgctggcagcaccactgtaaatccagaagggaagagtctgcatccaatacaggaaataaattcacattttgaaggaaaaaattcgacaatttaagccaaaatctaaaaaggacaattggattggcatatgtgagattggtgttttttcacctatttatttagttgagaagtttggggaattctcgtacagttttnttaggtggagtttgttttgtgcgagtgtctgtgtgtgctgttccctaactccagaacagttaaattcctgtagttggtagcagattagtacccagaagtggggttgttgctataacagataactgaggatattataaaagtggctttggaactaggtactgggcagaggctgggagagtttggagaaacaggagagaaaaggcctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttggccacctgcctgcgacacttcctggaggagccatggattattggtggaggctgcagggagctggcgatggagccactggtgtcagcagcagagagggaagaaaggaaaggaaggggccacaaatggttgaagtgggcaggtgggcacccagggagttaggggaccccgccttccagctctgggcatagaagagttagtcacatacctgaggatcctgaaacaagggctgagaaaacctcattgctccagctgagaggtagtagtggatttgccatttttaaacagttgcctaagaaaaaacgttgaagaatatgcagcagacactatatgtggcctgtaaagcctagaatatttactaaaatatttacagaaaaagtttgctggtccttgtgagaacaatgcagttcaaaaaaggatacagacagaagcatcctcttaaatcaggaatgtagtttccatttgtgggcacgaaaagatggacaagagaagtaaccaaacttcaatcttaaaatatttgttgcaccagaatttcacttcggatttttccgtctagattattttcaagatgagttttgaaacaaaccaagaaacctgcccctcacccaaaattgtttaaaaagagaccactcaagggagttcattatgccgtatggagatgtctgcagtcgcagcaaatcacattccagagaaggtctcgcgtaggtgaagacagccaggtgctttctctaagagatacagggtgggtgagagacaagccagggaggatcttaattcaagagaagaattcataccaagagctgaccaagaaggcagtaaattctgtgtacttgtagcagaagaaattggactaggaacttgcccaaagctttatcaaagaaaagcattgtgttcaatcttggtagaaacatgccagcaataagtgcttatgttccatagccatatcatgggcttctcacttttaaacctcctccaggggatgttctcagacatttcacaatccctctggggacattacagtagaagagaaacacatggaactgtaccagtgctttttgcccatgttcatcctaagctccggctttaggcagtgctttctgacctgggcggagtgaagacgctgctggtggctgaggccagtaacatggggcccctgcccagccaccctgaaggctgggtaggtccctcttttcaccaccagttttccacacctgtgtactctagattaacaaactctggataaacagatatttacattttaaactcaggcctacacagagtagttttccttataaggagcatgtatcacttagcaagaaactaaaaatggcaaatgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcatcatc

SEQ ID NO: 407254 - DNA, 2126 bp, Homo sapiens
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagccatcggagaccagagccgccccctctgctcgagaaaggggctcagcggcggcggaagcggagggggaccaccgtggagagcgcggtcccagcccggccactgcggatccctgaaaccaaaggaagaaaaacgctgaggctcacggtcactgagttagtcaatgtggggactgaaacccatacctcttactccaggcccctcccctacaccactgctagcctgtccgtcctggaaccccaaaacaacatttgtcatctttggtggaatgaattagttattgatggtg

SEQ ID NO: 407255 - DNA, 1875 bp, Homo sapiens
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagaaagctcctgctgcttctgtaccccgcctgtccctc

SEQ ID NO: 407256 - DNA, 1047 bp, Homo sapiens
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgagccaaacagctatttccagcgaatatataatcatccaccacatccaaccatgtctgttgatgaggtattaca

SEQ ID NO: 407257 - DNA, 6032 bp, Homo sapiens
  misc_feature (3616)..(3616): n is a, c, g, or t
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgtaagctttgcgtcctcacagcaggaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtgatccagctcacagctccacgaagactcaaaaggaaaagccatttttgcctcagggtttctcctctttattttcctgtggttttgttttttctttcccttttttgttcctccaaacaaaaacaaaatgcaggccgagcgcggtggctcacgcctgtaatcccagcactttgggaggccgaggcgggcggatcatgaggtcaggagatcgagaccatcctggctaacacggtgaaaccccgtctctactaaaaatacaaaaaattagctgggtgtggtggcgggcgcccgtagtcccagctactcaggaggctgaggcaggagaatggcatgaacctgggaggcagagcttgcagtgagccgagatcacaccactgcactccagcctgggcgacagagtgagactccgtctcaaaaaaaaaaaaaatgcattgtttataagccctgctgtctagaagtattgcgtttagccattttgagtacagcattaaattgaggagtggggaagagggaaattcacttgatttttgctgcacaggatatctgccaaaaataaatgagatttctggggtttctctaaggaatgttaaatttaaacacatgcactttgatactggagggaggtggaaagatgcattctgtcagtggagaggggactgaatagtgatgctttcatagaaccaaaaaacttactgcctgaaatgataatcctcttttttctctatcttgaaagctctaacctgaagagggtgatttttttttttatttattgttcaggtctgttactgtatatgttttctttgcaaatttaaattttttaaaccatttatatccaaaacagagaaacatgggcaccaggagataaccatttataaaagtgatagtgaactatcgactacagctttgtgcgagtgtgtgaaaaatcccaagaaaccagcgtgaggggaggcaatgctggttctttaaaaacacacacttcagaatttactggtacattttatttagaaaaatcctcgttactgttatcttttcctgaccgcaggtaattacgctccttattccatatttcagtggcattagaacactgtggttttgaaagaattggaaattcctagtttcaccagtttcggttttattggaactagagcacatgcccacttcttgctcagtattcctcagtgtttctgcttaatcgtgcctcagtttcttccagcttccaattggtgtttcccccaccccccttaattaaaagtcatctcagcttttaatcgtactgggagaccccatgcacagcctgccgagtcctcttcctaaccgcattgactgaggctgttgctggcagcaccactgtaaatccagaagggaagagtctgcatccaatacaggaaataaattcacattttgaaggaaaaaattcgacaatttaagccaaaatctaaaaaggacaattggattggcatatgtgagattggtgttttttcacctatttatttagttgagaagtttggggaattctcgtacagttttnttaggtggagtttgttttgtgcgagtgtctgtgtgtgctgttccctaactccagaacagttaaattcctgtagttggtagcagattagtacccagaagtggggttgttgctataacagataactgaggatattataaaagtggctttggaactaggtactgggcagaggctgggagagtttggagaaacaggagagaaaaggcctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttggccacctgcctgcgacacttcctggaggagccatggattattggtggaggctgcagggagctggcgatggagccactggtgtcagcagcagagagggaagaaaggaaaggaaggggccacaaatggttgaagtgggcaggtgggcacccagggagttaggggaccccgccttccagctctgggcatagaagagttagtcacatacctgaggatcctgaaacaagggctgagaaaacctcattgctccagctgagaggtagtagtggatttgccatttttaaacagttgcctaagaaaaaacgttgaagaatatgcagcagacactatatgtggcctgtaaagcctagaatatttactaaaatatttacagaaaaagtttgctggtccttgtgagaacaatgcagttcaaaaaaggatacagacagaagcatcctcttaaatcaggaatgtagtttccatttgtgggcacgaaaagatggacaagagaagtaaccaaacttcaatcttaaaatatttgttgcaccagaatttcacttcggatttttccgtctagattattttcaagatgagttttgaaacaaaccaagaaacctgcccctcacccaaaattgtttaaaaagagaccactcaagggagttcattatgccgtatggagatgtctgcagtcgcagcaaatcacattccagagaaggtctcgcgtaggtgaagacagccaggtgctttctctaagagatacagggtgggtgagagacaagccagggaggatcttaattcaagagaagaattcataccaagagctgaccaagaaggcagtaaattctgtgtacttgtagcagaagaaattggactaggaacttgcccaaagctttatcaaagaaaagcattgtgttcaatcttggtagaaacatgccagcaataagtgcttatgttccatagccatatcatgggcttctcacttttaaacctcctccaggggatgttctcagacatttcacaatccctctggggacattacagtagaagagaaacacatggaactgtaccagtgctttttgcccatgttcatcctaagctccggctttaggcagtgctttctgacctgggcggagtgaagacgctgctggtggctgaggccagtaacatggggcccctgcccagccaccctgaaggctgggtaggtccctcttttcaccaccagttttccacacctgtgtactctagattaacaaactctggataaacagatatttacattttaaactcaggcctacacagagtagttttccttataaggagcatgtatcacttagcaagaaactaaaaatggcaaatgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcatcatcaaaaaaacaacacagcacacaaccaagaaccacaacaccaacaacagcacccccccaccaaccgagcacaacagacaaaaccacaagcagagagacggggcggccaagaaaaacacgcgcgggcccacacagcagacccaacccagcaaaaaaagaagcagccaacggagaacacac

SEQ ID NO: 407258 - DNA, 4809 bp, Homo sapiens
  misc_feature (2570)..(2570): n is a, c, g, or t
ctatttttagacttttctttttagtaggaggctaaagtagcttaagctattaaggtttgttatgcttatgtctgcaggaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagagacatccagcaggaggccttccgagccagtcacacccactggcggggcgtttcctttgtctacaaccactacctgttctctggctgcttcctggtggtgctgctggccatcctgctgtacctgctgcggctgcggcgcatccacaggcgcactccccggagcagctcggccgccgccctctggatggaggagggccttcccgcccagaatgccccggggaccttgtgatccagctcacagctccacgaagactcaaaaggaaaagccatttttgcctcagggtttctcctctttattttcctgtggttttgttttttctttcccttttttgttcctccaaacaaaaacaaaatgcaggccgagcgcggtggctcacgcctgtaatcccagcactttgggaggccgaggcgggcggatcatgaggtcaggagatcgagaccatcctggctaacacggtgaaaccccgtctctactaaaaatacaaaaaattagctgggtgtggtggcgggcgcccgtagtcccagctactcaggaggctgaggcaggagaatggcatgaacctgggaggcagagcttgcagtgagccgagatcacaccactgcactccagcctgggcgacagagtgagactccgtctcaaaaaaaaaaaaaatgcattgtttataagccctgctgtctagaagtattgcgtttagccattttgagtacagcattaaattgaggagtggggaagagggaaattcacttgatttttgctgcacaggatatctgccaaaaataaatgagatttctggggtttctctaaggaatgttaaatttaaacacatgcactttgatactggagggaggtggaaagatgcattctgtcagtggagaggggactgaatagtgatgctttcatagaaccaaaaaacttactgcctgaaatgataatcctcttttttctctatcttgaaagctctaacctgaagagggtgatttttttttttatttattgttcaggtctgttactgtatatgttttctttgcaaatttaaattttttaaaccatttatatccaaaacagagaaacatgggcaccaggagataaccatttataaaagtgatagtgaactatcgactacagctttgtgcgagtgtgtgaaaaatcccaagaaaccagcgtgaggggaggcaatgctggttctttaaaaacacacacttcagaatttactggtacattttatttagaaaaatcctcgttactgttatcttttcctgaccgcaggtaattacgctccttattccatatttcagtggcattagaacactgtggttttgaaagaattggaaattcctagtttcaccagtttcggttttattggaactagagcacatgcccacttcttgctcagtattcctcagtgtttctgcttaatcgtgcctcagtttcttccagcttccaattggtgtttcccccaccccccttaattaaaagtcatctcagcttttaatcgtactgggagaccccatgcacagcctgccgagtcctcttcctaaccgcattgactgaggctgttgctggcagcaccactgtaaatccagaagggaagagtctgcatccaatacaggaaataaattcacattttgaaggaaaaaattcgacaatttaagccaaaatctaaaaaggacaattggattggcatatgtgagattggtgttttttcacctatttatttagttgagaagtttggggaattctcgtacagttttnttaggtggagtttgttttgtgcgagtgtctgtgtgtgctgttccctaactccagaacagttaaattcctgtagttggtagcagattagtacccagaagtggggttgttgctataacagataactgaggatattataaaagtggctttggaactaggtactgggcagaggctgggagagtttggagaaacaggagagaaaaggcctgtattgccatgaactgagcattaggggcagttctgctgagggatcagaagagaagaccaagggaattctgtcccagttgtggctcaaactgcctcaggtgcagcttaacctgcgtctctggaaggtaaaatgcatctgatccttgaggcaagagctgtgggggcatggctccctcacctggatttcaaagcgtgttaccagcagcctggggacccaggctctgcctctggatttacctgcatcgtatttgcgcttcgtggtcaaagttgttaagaaaggggtgagcttctggctacctaataagttggtcttggccacctgcctgcgacacttcctggaggagccatggattattggtggaggctgcagggagctggcgatggagccactggtgtcagcagcagagagggaagaaaggaaaggaaggggccacaaatggttgaagtgggcaggtgggcacccagggagttaggggaccccgccttccagctctgggcatagaagagttagtcacatacctgaggatcctgaaacaagggctgagaaaacctcattgctccagctgagaggtagtagtggatttgccatttttaaacagttgcctaagaaaaaacgttgaagaatatgcagcagacactatatgtggcctgtaaagcctagaatatttactaaaatatttacagaaaaagtttgctggtccttgtgagaacaatgcagttcaaaaaaggatacagacagaagcatcctcttaaatcaggaatgtagtttccatttgtgggcacgaaaagatggacaagagaagtaaccaaacttcaatcttaaaatatttgttgcaccagaatttcacttcggatttttccgtctagattattttcaagatgagttttgaaacaaaccaagaaacctgcccctcacccaaaattgtttaaaaagagaccactcaagggagttcattatgccgtatggagatgtctgcagtcgcagcaaatcacattccagagaaggtctcgcgtaggtgaagacagccaggtgctttctctaagagatacagggtgggtgagagacaagccagggaggatcttaattcaagagaagaattcataccaagagctgaccaagaaggcagtaaattctgtgtacttgtagcagaagaaattggactaggaacttgcccaaagctttatcaaagaaaagcattgtgttcaatcttggtagaaacatgccagcaataagtgcttatgttccatagccatatcatgggcttctcacttttaaacctcctccaggggatgttctcagacatttcacaatccctctggggacattacagtagaagagaaacacatggaactgtaccagtgctttttgcccatgttcatcctaagctccggctttaggcagtgctttctgacctgggcggagtgaagacgctgctggtggctgaggccagtaacatggggcccctgcccagccaccctgaaggctgggtaggtccctcttttcaccaccagttttccacacctgtgtactctagattaacaaactctggataaacagatatttacattttaaactcaggcctacacagagtagttttccttataaggagcatgtatcacttagcaagaaactaaaaatggcaaatgagtttttcatcctttaagaaaaaaatcagctttagaattctctgcggtcagttgtgtgcaatgcaacaaaactacctttcagtaaattacttagttatttatttcagtgttttgtttcttttgatactaagtttccctttcaataatgaatgatgtgaccaaccaaggagaatttgtttgttctgtactaaaattatattttacagttaggaattataaaaagcaagggagcatctttaaatgttttttgtttaagcgatgtcttccatccaaagtaagaataatactctcggaaggtccttttggtgtcatgtcacttgctgtatgtggcagccttacagtgccacacttgggtactgaaaaatcaataaaacgaaagttcatcatc

SEQ ID NO: 407259 - DNA, 2225 bp, Homo sapiens
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctgctcgacagagatacgaagacagaatatttgccaacaccattcaaaagaacaggctcctgggtaaacagactggtctgactcctgatatgccgtacttggacccctgcctacccctagacattaaagatgaaatccagcaaaatggacaaaccatatacctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggattattgtgcaacaaagtggtccattttgcgggaacgctttgaccgaggactgtacgcctctcatgctgacctccacaggcttaagtatcagtgcttcaaatcggcctggatgtttgaggtgtttcataggggcttttcgtttcctgtcaactataaaagcttaaagactgccttgcaagtttacgacaaggaggttcagtggacccttggagccatcctctacaggacccgctttctaccattaagccatcggagaccagagccgccccctctgctcgagaaaggggctcagcggcggcggaagcggagggggaccaccgtggagagcgcggtcccagcccggccactgcggatccctgaaaccaagaaaatagggatgctgataataccttgctcagggggttgtccaaagctgtgttgtgcagtatggcagccaccaccatatggggccaccaaacacttgcaatgtgctgcttggaattgagatgcgctgcaaacgcaaagtacgtgctggatttcaaagacttagtacaaaaagaaaaaagaacgcaaaacatctcattaataatttttgtattgattccatattgaaatatattgcatcaaataaaatatatctttaacattgaaat

SEQ ID NO: 407260 - DNA, 1278 bp, Homo sapiens
agcgggcaggcggtgacgtgttgccggcgggggccgggcgggggtgcggctccaggaaaggagcgcggcctccaggaagccggctggccgtgatgctgcccactggtggtcccccgctcccggggtccccggccggccaagcaggagggctctaactccgtgaggaccccagcattatttctataattgtttgtgagaaggactgaatcccagagcattgccttgttgctgacctttcagtatggggaggattggcatctcctgtctttttcctgcttcttggcattttagcatatctccagtagggtgtcctcgaattctgaataccaatttacgccaaattatggtcattagtgtcctggctgctgctgtttcacttttatatttttctgttgtcataatccgaaataagtatgggcgactaaccagagacaagaaatttcaaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaagccagcagaaagctattctggaagaccttctgaccgatatccccgtgcactttgactttctgttttctgactctcatgcagaagtaatttctgggaaacaagaaggtgtgtatgcttggattggcattaattttgtccttggacgatttgagcatattgaagatgatgatgaggccgttgtggaagttaacattcctggaagtgaaagcagcgaagccattgtccgtaaaaggacagcgggcattctcgacatgggcggcgtgtcgactcagatagcgtacgaagtccccaaaactgaagaagtagctaaaaacttgttagctgaatttaacttgggatgtgatgttcaccaaactgagcatgtgtatcgagtctatgtggccacgtttcttgggtttggtggcaatgctatgctcaaatcgtccaaggacaaaattaatgccaatccaagcatacacacattcttgtttcccag

SEQ ID NO: 407261 - DNA, 339 bp, Homo sapiens
cctacgagggactggagactttgacctgtgtcgagagactatccagcctttcatgaataaaacaaacgagacccagacttccctcaatggggtctaccagcccccaattcacttccagaacagtgaattctatggcttctccgaattctactactgcaccgaggatgtgttacgaatggggggagactacaatgctgctaaatttactaaagctgcaaaggtacccttgagagacgccgtctgctctgcatgcttttgagagaccagtgtggacggtgacgggttatgtcctcctttcacattgacagggaaagacggagtatagaaggctgcactgca

SEQ ID NO: 407262 - DNA, 2043 bp, Homo sapiens
agggcccgggcccaccagctgcctgtcccctcagtgtccgacttcttggaggagttcccgggtgagggtcgtgagtgtgtcaactgcggggccctgtccacaccgctgtggcgccgagacggcaccggccactacctgtgcaatgcctgcggcctctaccacaagatgaatggcgtcaaccggccgctcgttcggcctcagaagcgcctgtcctcgtcccgccgcgccggcctctgctgcaccaactgccacacgaccaacaccacgctgtggcggcggaactcggagggggagcccgtgtgcaatgcctgcggcctctacatgaagctgcacggggtgccgcggcctctggctatgaagaaggaaagcatccagacacggaagcggaagccaaagaccatcgccaaggccaggggctcctcaggatccacaaggaatgcctcggcctccccatctgctgtcgccagcactgacagctcagcagccacttccaaagccaagcccagcctggcgtccccagtgtgccctgggcccagcatggccccccaggcctctggccaggaggatgactctcttgcccccggccacttggagttcaagttcgagcctgaggactttgccttcccctccacggccccgagcccccaggctggcctcaggggggctctgcgccaagaggcctggtgtgcgctggccttggcctaggtccccaggccagcccatgtcaggggaacagcctggaacagaccacccactgagtcacctccgtgcctgctttgctccagcacagcagagaccagcaggccccccaacccagagactgggtctgctggagtctccacacagtggtggggaggccttctggacagacggcagtcgggccccagagcaagaaggctggtgagggaagggctcagcttcccaccccacgtacagcaagggactccccaggtgcggcccaaggctccggaccacactggccccctgcggcggaggccaacgcagggcaccaccaccaccaacttgaattccgtcatcaatgctcaccgtcaatatgtttacaagttgtagcagttgggggaaaacagtcaacctcccagtgtaaaaccaagattcccagtgaagcacctgaggccaagcaggggagaggaatgaggggagcagctggacatgggcctcctgaggcctcggggctgtccttcattgcccacatggatagacggagctgtggtgcagagaacttttcccgcaacaggtgcaggactgccagggatcggagtgcgggccgcgcacggtgccaggattccgccgaggggaagccgctcacattgcagtcatcacagacttacgcacttgtttggacagtttttccagaggggatgggaaagggccttgttctagctgaatctgtgtatcatgaccatttctgacaggcagaatgaattgtctggtagccctgtcctgacccatccaagcgctgttggggctggtggtgacgtggtcacatgtcctggcatatctggggccacgcagtttagtctcttgtcccaggagaattgttagtgacccctctttctcttgcaagccccctccacactgggttggatgataccttaatgagtgacgctggcgagaggcaccctacccgacgcagctgtgaatggccggtgatgtatgtcaggaggccacagggagcggaggagcggggcaggcagccacagggccctgcggggagcacatcctcgcctccgtccggctgctgcccttcaacaacaagccctgatttttccagcaatgccagaaacctggattttaagtcttccaatttgattcaaaaatatttttaacattgtgagccagctagacccccagtgcaccaccccatattgaaaaacagttgtctggcatcagcttcaggagcggtccggtcattctgaaactgtccctccagaggttcttccagccccacttctatgcgatgtcatcttttctaaaagagacaaatgaagccacagggaaagtgaaataaagccttgaacctca

SEQ ID NO: 407263 - DNA, 556 bp, Homo sapiens
agggaaccggtcagaaatcccgggtcggactactataactaaattcggggccgggtcgcctcttgcaagccccctccacactgggttggatgataccttaatgagtgacgctggcgagaggcaccctacccgacgcagctgtgaatggccggtgatgtatgtcaggaggccacagggagcggaggagcggggcaggcagccacagggccctgcggggagcacatcctcgcctccgtccggctgctgcccttcaacaacaagccctgatttttccagcaatgccagaaacctggattttaagtcttccaatttgattcaaaaatatttttaacattgtgagccagctagacccccagtgcaccaccccatattgaaaaacagttgtctggcatcagcttcaggagcggtccggtcattctgaaactgtccctccagaggttcttccagccccacttctatgcgatgtcatcttttctaaaagagacaaatgaagccacagggaaagtgaaataaagccttgaacctcaaaaaaaaaaaagtcgacgcggccgcgaat

SEQ ID NO: 407264 - DNA, 1781 bp, Homo sapiens
  misc_feature (57)..(57): n is a, c, g, or t
ggccaaagaagccacgcccggccacaccacccacgcctgcggtgtgaccgtgagagntctccaaacctctctgggccggggcagaggagacccgctacatggcaggaaggggaagtgaggccacacctgacccctctgtaaacaccccctcttcgcttccaggatccacaaggaatgcctcggcctccccatctgctgtcgccagcactgacagctcagcagccacttccaaagccaagcccagcctggcgtccccagtgtgccctgggcccagcatggccccccaggcctctggccaggaggatgactctcttgcccccggccacttggagttcaagttcgagcctgaggactttgccttcccctccacggccccgagcccccaggctggcctcaggggggctctgcgccaagaggcctggtgtgcgctggccttggcctaggtccccaggccagcccatgtcaggggaacagcctggaacagaccacccactgagtcacctccgtgcctgctttgctccagcacagcagagaccagcaggccccccaacccagagactgggtctgctggagtctccacacagtggtggggaggccttctggacagacggcagtcgggccccagagcaagaaggctggtgagggaagggctcagcttcccaccccacgtacagcaagggactccccaggtgcggcccaaggctccggaccacactggccccctgcggcggaggccaacgcagggcaccaccaccaccaacttgaattccgtcatcaatgctcaccgtcaatatgtttacaagttgtagcagttgggggaaaacagtcaacctcccagtgtaaaaccaagattcccagtgaagcacctgaggccaagcaggggagaggaatgaggggagcagctggacatgggcctcctgaggcctcggggctgtccttcattgcccacatggatagacggagctgtggtgcagagaacttttcccgcaacaggtgcaggactgccagggatcggagtgcgggccgcgcacggtgccaggattccgccgaggggaagccgctcacattgcagtcatcacagacttacgcacttgtttggacagtttttccagaggggatgggaaagggccttgttctagctgaatctgtgtatcatgaccatttctgacaggcagaatgaattgtctggtagccctgtcctgacccatccaagcgctgttggggctggtggtgacgtggtcacatgtcctggcatatctggggccacgcagtttagtctcttgtcccaggagaattgttagtgacccctctttctcttgcaagccccctccacactgggttggatgataccttaatgagtgacgctggcgagaggcaccctacccgacgcagctgtgaatggccggtgatgtatgtcaggaggccacagggagcggaggagcggggcaggcagccacagggccctgcggggagcacatcctcgcctccgtccggctgctgcccttcaacaacaagccctgatttttccagcaatgccagaaacctggattttaagtcttccaatttgattcaaaaatatttttaacattgtgagccagctagacccccagtgcaccaccccatattgaaaaacagttgtctggcatcagcttcaggagcggtccggtcattctgaaactgtccctccagaggttcttccagccccacttctatgcgatgtcatcttttctaaaagagacaaatgaagccacagggaaagtgaaataaagccttgaacctca

SEQ ID NO: 407265 - DNA, 415 bp, Homo sapiens
ccacagaactgcccagctgaggcagcctaaattgctaacccactgaaccgtgagcatataaaatggtggttgatttatgcttctatctctgtctttaaggtttggtgtagcagtatataaatgatcctggcactaacccagcctgggcattttttcatgttcaaggaagttcttataacttaccccacacaagtttttagaatatttccaataaggctataatcagctaacttaaaactcttgcaggtcacatgataaacaatgctactatttatacaaatatgaagtcaaacaattttgaaaatttcatgttgaatgtatttcaaatatgaatttcaagcagatttatatttgaaagtattttgtttaattttacccattttattttgttgagacatttaaatcttacatgatt

SEQ ID NO: 407266 - DNA, 439 bp, Homo sapiens
ctgagtcgatctccacattcatctacatgaacgtgggggcgttggttttggcggccaggctgtaaaatgtagggcttgtctcagtttgctatttaatcaacatgtggacattttagcagagaaaccccagagcaaataggaatgagaagctacctgattaaaatgatgaaatgatagagaatgttttttggctgggacattttaaccaaagttgcacaactgatgctgattgccttccttgtagtttagtagaatttgtcatttgtttagctccttttcgttccagtgaaaatagataagctttactgagtggcttactttgaggtgtggactcctttgtaagtagctatagggtctcttcttgaacactgaccaaagaatccacctttaatcctattcagttaagttgaagcccctctaaaaaattttgttgttaata

SEQ ID NO: 407267 - DNA, 355 bp, Homo sapiens
taaggctgtttcagagtctgagttgacttctctttaatctacctatagaacttttaggtttcaaaaaatactttttaaatgactttttgggtttggaaagtacctttaatacatttaagctagttttcctcctggaaatatttagaatttcttccttaattggcaacctttatagaagtctggtaagatttgtcgcaaagatgtgccacagatggacacaaatttcccattcgggagcaatatcttaccacagtggtggctaaatgctagggacaaaatacaaggccggaactttccttccctcagataccttgtgctgtggtgttttgttgccactttctccctctcattttca

SEQ ID NO: 407268 - DNA, 287 bp, Homo sapiens
ctgagtcgatctccacattcatctacatgaacgtgggggcgttggttttggcggccaggctgtaaaatgtagggcttgtctcagtttgctatttaatcaacatgtggacattttagcagagaaaccccagagcaaataggaatgagaagctacctgattaaaatgatgaaatgatagagaatgttttttggctgggacattttaaccaaagttgcacaactgatgctgattgccttccttgtagtttagtagaatttgtcatttgtttagctccttttcgttccagt

SEQ ID NO: 407269 - DNA, 690 bp, Homo sapiens
cgcgcctggccagatccttattttttcaattgcaatacagcagtatgcaaggcacttactgtatgccaaagcttatgccgagagctggctgccagcagctcctcctgcctcgaggcctttgtccatgtcatcatttcccctttggctgtaacagctgcagttctctcataattttaggtttcatcttaaatgtcacttcttcagaggcttcttgacagcacaagtcagggcccttgttagtttcatcacatccattacctttccttgatcacttgtaccatcatctgtaatttatttttatgtttaatacgggtgtgggatttctgatttttttttttgctagactggaagctctcagagggcaggaaccatttgtttccctgccacagagatgttcaataaatattgtcaattgaatgtgcaaataatctcacttaaccacagctatgagggatgctattttatccccattttagagatgactaaactgaggcttagaacaattaacccaaggtcacagtgaattagtggatccatgtgtctgcctccacacagcctgtgtgttcttaattattgatcactaagcaacagctgcctctcacaaactggcaggaaacttcaacttttcccttttatcaatatattgtgaacgccttttcttgctaataaatatacatttgtgtgcgtaat

SEQ ID NO: 407270 - DNA, 485 bp, Homo sapiens
aggacaagccagaaaaggcgttcaccatatattgataaaagggaaaagttgaagtttcctgcccgtttgtgagaggcagctgtaatttatttttatgtttaatacgggtgtgggatttctgatttttttttttgctagactggaagctctcagagggcaggaaccatttgtttccctgccacagagatgttcaataaatattgtcaattgaatgtgcaaataatctcacttaaccacagctatgagggatgctattttatccccattttagagatgactaaactgaggcttagaacaattaacccaaggtcacagtgaattagtggatccatgtgtctgcctccacacagcctgtgtgttcttaattattgatcactaagcaacagctgcctctcacaaactggcaggaaacttcaacttttcccttttatcaatatattgtgaacgccttttcttgctaataaatatacatttgtgtgcgtaat

SEQ ID NO: 407271 - DNA, 1197 bp, Homo sapiens
agaagagctaaattgcctccccaaaatctctcctttactgtgtagttcatgacatgctccatccttgtgttttcctaaaagcctttaagtgcccctctcatttaagaaagtacaggaataatgaaccttagtgtctgagactaaaagttattgtactcttcctgagcacagtacaatctcaaatcctgaagaaagttgtgtttctgtcctttcactgctttgttctttggggtatattcactggattttggaattataagacaaaatttattgattacaccattctgttcagaaattcaaatattaaattatagacttcaaggcttttcttttctgatttaaaaagcaatgaagctgggtttcctctgaaaaaagtctcgtttgtttattacaaggcacactgtatcatggttccctggtttatatatcaccattactctgtaatgcctgcctctgtgtagatgtgacggaaagactgaccagtgattctttacacattgggaacctttgaagacctctttggtttgtagctgaaggaactttgcacagtagaattgcaaatcactgttgttctgagagtgacttgctctgccctaattggtctgtttgctgctgttgcttcttaatatttcaaagctatgcaaaatgatgtttccatgtgtctttatagcatttcttcacttcagcttacattagaacatctgcttaacccttttgctcttacctagcgtatgcccgcagagctgtcttgcctccaaatgtcatttttatttttgttaattaatggcatgctcttatctcactggtgatcttggggatcatagaattttagagttggatggcaccttaaaataggtaggatataaatacatttgtcagaaaaaaaaaagaaaatgaattcggggacacagttccaacaggtctaatatttcagtataatgaattatctttccaagaagattcaattaattatagagattgtgattgtatcagatgtcgcaaactatggcccactactgtatttgtttttgtaaataacatgttattggaacacagtcatgcccatttgtgtacatattgttatggctgcttttgtgcaatgatagagttgagtagttgcaatagagatcatatgtcctgaaaagcctaaaatattttgttgtctggtccttcacaaaaaacggttgctaatcccta

SEQ ID NO: 407272 - DNA, 514 bp, Homo sapiens
tccaccttatatgtgctgagagctgttctgctgccattttctctccctgcctcaagagcacatttaagtgcaagtgaatggggtgggattgtgattgttacactgagtgattgcttagaatctgccctaccgtatctgccggtgtataaaactctaccgatgttaccaaactctgagaggatgtgaagctctagttttcactgtgctgagctgattacctcatgtcgtcaccagggggcagcaccttcccatgcctttggacttaggagcctcggggcggtgggaagcccacaccaaaccccatgccttagctggtcacctcttaccttccaagcctgatccaagtttgggcaaaacggatgtaaatgtgtttttaattttttttttcttatttgagaggggggcaattggagggaggaaatacagcttatatgttggcatacacatttgaaatatttggtactttctaagcaggagttttatgtgtattctgtgttcttttctctactgagaa

SEQ ID NO: 407273 - DNA, 356 bp, Homo sapiens
caaacctatagatggcatttggaaagaagtacacgcataggcttcaaaaaaccctgaacaccagaaacctaattagcactttcattttaggggcacgggctttcccttatccttttctacagccaaccttaatggggtccaattaaggcaacaatgaaaggttacaaaagtctacaaaaaggtcccattacagcatttaaacagggttcattttttttaatcaaatagtttacactgtttttttgttgttgttgtttgttgttgttgttgtgtttgttttcttttttgagcctgttgcccaggctagagtgcaatggagtgatctcggctcactgcaactccagcctgggccacac

SEQ ID NO: 407274 - DNA, 384 bp, Homo sapiens
agaaaagggcaggctttggagtagctcagttgtattataaccttggcttctttactcacctaggacatacattctctctttagctgtagcttcctcccttctgagatggaaattataagccatctcacagtgttgtgaggattggagctcaagtgtgtaaaatgcctcctctgtgggctctccttggagagttcttgtatcctattgattgtcatcaaaggaaaaaagtggcaggatgatggcataagtgggaagaaccttgagtttaatagtctgaaaaagtggttacaggttcttgctatgcttttcctctctgtggttttctgaacccatcgcctaacctgaagccttaaacttcatctgcaaaaatgttttgtggcaggt

SEQ ID NO: 407275 - DNA, 632 bp, Homo sapiens
taccaaaaagagagagagagagagattagtaatctaagcctgagtacaaaagaacagtgaaaaaaaattaataaataaaagaatagtgacaaagaggaatttggcctctcagagtcagaaggatcataccctttaaaatggctataatggtaaattctgtattatgcatatttttccacaattttaaaaacaaaacacaactagccttttttggaaaaccacactcacactgtcttcttgggaaagaaattcaaaccatactccaaatcgaagctctcatgtgggttaaaaccacttttgttcctgtaagttgtttatttttatactattgtataaataactagtagaattctcttttataaatttaggtcactgttacttagcaggacattccaaggttttaaagaatatactaaaaggtcttctaagacataataaaatatttttccatgatatggataagcatcttggtgatttttgtaaattaaaattattcctaagcctttccttcctcccaaaataaggaaaatgcctatagaagatactgattttcctaagtgctatcaaataagtgatctcaatgtattatttaccaagaataaaaataggtaagctattatgcccttatggaa

SEQ ID NO: 407276 - DNA, 1506 bp, Homo sapiens
agcgggtccggggcggggctgtaccgggcgctgggcggaggagccttggctggggactgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagct

SEQ ID NO: 407277 - DNA, 2510 bp, Homo sapiens
ggactgggtcggcggcttccttccggctctgcgctcctggctggggctgctgggcggctggggccgggtccccgcacccggctctcaagtccgggattacccgcagggcctgagaagcgctttgccccctacagcctctcgagccagcccttggctcggaattggagaatggtcctcattcttacccagatctcacacgccgtccccgctcccgatcccagggggtgacaggcgcgcacgcctttcaaacacgtgttaaaatccaagacgtcgtctcaaatgccagagatttgcgggaatgctcctggaaggcctcaaaatcgccgcaagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttcttgcattgctatgaataaatgcctgagattgagtaatttaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaagaaaaaaaaaaaaaaaaagaaaggaagcgggcgggggggcgcttattatcatatgtttcttagtcatcggggagagccgaatattattagtcacaaccatccttttattgttattatgtgaacgaggaggggtctatgagatgtaggtgttattttgaaagaaagagaaagacatgtgggagatatataaaagttaataaagcatgttgagtggcaaaaaaattgtacttgtagtattaattgataaggaaaagattactaatttgattgaggagagggataaagaagaaaaaggagaaaaacacgatatttgtagaataatatgatagattagatgatggatatattaaataaaggataatggtggggcgaagtatatcgagtgatgcacagctacaccagtgatactatatagttaagag

SEQ ID NO: 407278 - DNA, 2674 bp, Homo sapiens
ggactgggtcggcggcttccttccggctctgcgctcctggctggggctgctgggcggctggggccgggtccccgcacccggctctcaagtccgggattacccgcagggcctgagaagcgctttgccccctacagcctctcgagccagcccttggctcggaattggagaatggtcctcattcttacccagatctcacacgccgtccccgctcccgatcccagggggtgacaggcgcgcacgcctttcaaacacgtgttaaaatccaagacgtcgtctcaaatgccagagatttgcgggaatgctcctggaaggcctcaaaatcgccgcaagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattgtccaagctggcagcgtttctgctcataaaacattctgaagaaccttgtgggccctctgtgtatgtcacaggattcactccattagatgggaagctcctctgcagatcttttctgagtaatcccatctccatttctggcttctgctgagatggctgaggagacctgcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttcttgcattgctatgaataaatgcctgagattgagtaatttaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaagaaaaaaaaaaaaaaaaagaaaggaagcgggcgggggggcgcttattatcatatgtttcttagtcatcggggagagccgaatattattagtcacaaccatccttttattgttattatgtgaacgaggaggggtctatgagatgtaggtgttattttgaaagaaagagaaagacatgtgggagatatataaaagttaataaagcatgttgagtggcaaaaaaattgtacttgtagtattaattgataaggaaaagattactaatttgattgaggagagggataaagaagaaaaaggagaaaaacacgatatttgtagaataatatgatagattagatgatggatatattaaataaaggataatggtggggcgaagtatatcgagtgatgcacagctacaccagtgatactatatagttaagag

SEQ ID NO: 407279 - DNA, 2454 bp, Homo sapiens
agcgggtccggggcggggctgtaccgggcgctgggcggaggagccttggctggggactgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttcttgcattgctatgaataaatgcctgagattgagtaatttaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaagaaaaaaaaaaaaaaaaagaaaggaagcgggcgggggggcgcttattatcatatgtttcttagtcatcggggagagccgaatattattagtcacaaccatccttttattgttattatgtgaacgaggaggggtctatgagatgtaggtgttattttgaaagaaagagaaagacatgtgggagatatataaaagttaataaagcatgttgagtggcaaaaaaattgtacttgtagtattaattgataaggaaaagattactaatttgattgaggagagggataaagaagaaaaaggagaaaaacacgatatttgtagaataatatgatagattagatgatggatatattaaataaaggataatggtggggcgaagtatatcgagtgatgcacagctacaccagtgatactatatagttaagag

SEQ ID NO: 407280 - DNA, 873 bp, Homo sapiens
ggcttccttccggctctgcgctcctggctggggctgctgggcggctggggccgggtccccgcacccggctctcaagtccgggattacccgcagggcctgagaagcgctttgccccctacagcctctcgagccagcccttggctcggaattggagaatggtcctcattcttacccagatctcacacgccgtccccgctcccgatcccagggggtgacaggcgcgcacgcctttcaaacacgtgttaaaatccaagacgtcgtctcaaatgccagagatttgcgggaatgctcctggaaggcctcaaaatcgccgcaaggtttaagacatccgtttccatgttgaaacaaagccctctctaatcctgcagtgaccataaggcagactttacctccaaattctggtcccctgtcctgtgttttaacttgtgttaagatcagactcggctttctctttccctttattcagaattttgcacgatagtatctaagactggtgaacactacactctgaagtcagttttttgtgcataggttacctgtatacaatggataaaaataattgcaaaagttaagcttgtaacttgatacatattatcctgttatttttaaaggttttgtgttggggaagagaattttcctgtctcaaggtagcattttatttctaagacttttcagagtaaaaaaagttcagtaaaaaaattgctgattttcttttttgttttcattgtgtattaccagtttaaattcagttgctgtacctctcagaaattaaagttaggatgaaattagaactaacacttaatttaaatgatttgaatttacctacaactgcaataataccttactggtaaacacttactctttttaaaacag

SEQ ID NO: 407281 - DNA, 2508 bp, Homo sapiens
agcgggtccggggcggggctgtaccgggcgctgggcggaggagccttggctggggactgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttcttgcattgctatgaataaatgcctgagattgagtaatttaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaagaaaaaaaaaaaaaaaaagaaaggaagcgggcgggggggcgcttattatcatatgtttcttagtcatcggggagagccgaatattattagtcacaaccatccttttattgttattatgtgaacgaggaggggtctatgagatgtaggtgttattttgaaagaaagagaaagacatgtgggagatatataaaagttaataaagcatgttgagtggcaaaaaaattgtacttgtagtattaattgataaggaaaagattactaatttgattgaggagagggataaagaagaaaaaggagaaaaacacgatatttgtagaataatatgatagattagatgatggatatattaaataaaggataatggtggggcgaagtatatcgagtgatgcacagctacaccagtgatactatatagttaagag

SEQ ID NO: 407282 - DNA, 2672 bp, Homo sapiens
agcgggtccggggcggggctgtaccgggcgctgggcggaggagccttggctggggactgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattgtccaagctggcagcgtttctgctcataaaacattctgaagaaccttgtgggccctctgtgtatgtcacaggattcactccattagatgggaagctcctctgcagatcttttctgagtaatcccatctccatttctggcttctgctgagatggctgaggagacctgcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttcttgcattgctatgaataaatgcctgagattgagtaatttaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaagaaaaaaaaaaaaaaaaagaaaggaagcgggcgggggggcgcttattatcatatgtttcttagtcatcggggagagccgaatattattagtcacaaccatccttttattgttattatgtgaacgaggaggggtctatgagatgtaggtgttattttgaaagaaagagaaagacatgtgggagatatataaaagttaataaagcatgttgagtggcaaaaaaattgtacttgtagtattaattgataaggaaaagattactaatttgattgaggagagggataaagaagaaaaaggagaaaaacacgatatttgtagaataatatgatagattagatgatggatatattaaataaaggataatggtggggcgaagtatatcgagtgatgcacagctacaccagtgatactatatagttaagag

SEQ ID NO: 407283 - DNA, 1960 bp, Homo sapiens
accacattattcacatcaacggagaagtaccctggtattacagctggaccagtgatgaagctgtactgtgttcttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttcttgcattgctatgaataaatgcctgagattgagtaatttaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaagaaaaaaaaaaaaaaaaagaaaggaagcgggcgggggggcgcttattatcatatgtttcttagtcatcggggagagccgaatattattagtcacaaccatccttttattgttattatgtgaacgaggaggggtctatgagatgtaggtgttattttgaaagaaagagaaagacatgtgggagatatataaaagttaataaagcatgttgagtggcaaaaaaattgtacttgtagtattaattgataaggaaaagattactaatttgattgaggagagggataaagaagaaaaaggagaaaaacacgatatttgtagaataatatgatagattagatgatggatatattaaataaaggataatggtggggcgaagtatatcgagtgatgcacagctacaccagtgatactatatagttaagag

SEQ ID NO: 407284 - DNA, 245 bp, Homo sapiens
ctgtaatgccattgcttttaacctttttctattatttctctgtagaaacattcaaaattgtagtcaacatcaacattcacatgttatgaatgcctgtttaattataagtatttttccaggtagttgcttttcttgatagtcatactttttaatggcttcaccatttttctgtcataaataccataatttacttgacattttttattgtcagaaatttagattcttttctattttcctacaataaa

SEQ ID NO: 407285 - DNA, 391 bp, Homo sapiens
atccttctcaaactttaatgtgtattaatatttgaatcacctagggaatttcgttagaatgcagattctaattcagtagatctggagtagggcctgagattctggagtcctaacatgcacccaggccaggagcagtggctcacacctacaatcccagcactttgggagggcaagtcaggaggaccactcgaggtctggagtttgagaccatcctgggaaacatagcaaaaccctgcttctattaaagaaaattatttttaataaaaataaaatgtacccgggtgatgccaataccgctggctaaggtttgagatcacatttgccctgagatgcagcaatacttcaaaatccctatatttattttaactaattaggaagactttaattttac

SEQ ID NO: 407286 - DNA, 949 bp, Homo sapiens
atttttgagttaccactaaaaatggaaggaaatatgcaatgttattttggtagctctaagaaaatatcttgcaagctccaccttcactttgcatcttagttttgaacaatcctattcaattttctcattctctagtgattaccttcatacttttatgcaggaaaaagtccgtatcatctggcattttatcaagactcagcaactggaatgttaaactaaagagggggatatttcactttaccaagtagatagatggtatagagcttaaggcattttcatgctcataaatctgataggcaacagtagctcctactgaaatttcttaggtagggaatgtttattaatatttggaaaatatacttccatcattgcaatgtggagcttcattcataagttgtaatgattctttagcaagtacacttaaaagcctttgcaggtagaatgtcaagatttgattataaataaagtgacccagggaatttagaaaaaaattattttaaaaaatatgtttgatgctattttgtatttttacagttttgattgggtaatgtttctgttcttctgaaaacagacccttggcttcacacattttaaaaatgtttgctacttgttaagggagtcagattaacttccattgggctaatgaatgctcaaatttctaatgagaaactaacactttaaaatttatcatacaacagaaaatggccaattaatggtcctgtataagtggaaaactgttaaggaggtctcaggttttgaaatataactcaacagtatattaaccattgacaagaatggatttttggaattgagaagggtagacaaacttcaggatactaggcaagaatatataaagaatatttcccatgcgttttaaatccgtatgacccagtgttctagagttctgtataaaatgataccaacaacaaataaagatgcttcccaagta

SEQ ID NO: 407287 - DNA, 3626 bp, Homo sapiens
ctcggcagcgtcatagcggcgggcatcccatctgcacgtcacacctctttctcacctggacacgcatcccttcctaccctgccagccacgacgtttcctctttcccctctccaatgcccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 407288 - DNA, 3742 bp, Homo sapiens
aaggctaaaaactccactagtcggaagtgacgtgccagcttagccccgcaggtccgccacgtaatttgccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacacctcgccggccggggcgccagtccagcgcctgcgggcaatgggcttcagcgctcgagcagcgcatgcgcgggcctgtatctccagaggattcctcgggtcacctggacgccagcatctcagccacctgccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagatccgtcctggtgccttactgtgcatacagttctactcgtctcagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 407289 - DNA, 3717 bp, Homo sapiens
aaggctaaaaactccactagtcggaagtgacgtgccagcttagccccgcaggtccgccacgtaatttgccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacacctcgccggccggggcgccagtccagcgcctgcgggcaatgggcttcagcgctcgagcagcgcatgcgcgggcctgtatctccagaggattcctcgggtcacctggacgccagcatctcagccacctgccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 407290 - DNA, 3334 bp, Homo sapiens
aagcttatcagctgtcattagtgtcaatgtattttatgtctggcccaagacacttcttccagtgggcccagggaagccaaaaggttggatattgtgatttagaagaatgagagaacagtgtcagagaatcaagcttagactccagtggattaatcataaagctcttataacattaaactttaaaatatggttaatttaagaaatgttaatatttttatgacattttttacttctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 407291 - DNA, 2054 bp, Homo sapiens
cctcatctagctccccactctggcttctcccgccagcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 407292 - DNA, 1806 bp, Homo sapiens
aaggctaaaaactccactagtcggaagtgacgtgccagcttagccccgcaggtccgccacgtaatttgccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacacctcgccggccggggcgccagtccagcgcctgcgggcaatgggcttcagcgctcgagcagcgcatgcgcgggcctgtatctccagaggattcctcgggtcacctggacgccagcatctcagccacctgccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggttcgacctttgcccctgcatagcccctcaggctgagtgcagcgtagctttgcgtagcctgggatttgtcagcctgggatactcattcttctgctctccttctctaaatccagttctttctgccaggtgtactcaaagggtctttgctacggaaaagtgatttctcccatccccttctaaccatttttgtgttcttatctctggtcagcaattatgtgcttaatctgttccaaagaaaagattcat

SEQ ID NO: 407293 - DNA, 1721 bp, Homo sapiens
aaggctaaaaactccactagtcggaagtgacgtgccagcttagccccgcaggtccgccacgtaatttgccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacacctcgccggccggggcgccagtccagcgcctgcgggcaatgggcttcagcgctcgagcagcgcatgcgcgggcctgtatctccagaggattcctcgggtcacctggacgccagcatctcagccacctgccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagactcagggttccagtaaccagtgatggattcaccccatctcccaaataaagtttacttgttttacattccatgattctgtt

SEQ ID NO: 407294 - DNA, 585 bp, Homo sapiens
cagctgtcattagtgtcaatgtattttatgtctggcccaagacacttcttccagtgggcccagggaagccaaaaggttggatattgtgatttagaagaatgagagaacagtgtcagagaatcaagcttagactccagtggattaatcataaagctcttataacattaaactttaaaatatggttaatttaagaaatgttaatatttttatgacattttttacttctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagaggtaagagacaagatagatcaattgggggttgtgtgtcagtttactaacaagaaaaaaaaggttgatggctgggagtcacaagttttgaaaatggagaaacaaagaggttgaattgattggaagagaagatggagaataacaagaaggggcaaatctggagttaggacttaacatagggataaatgtcgggtcagggatgcaaa

SEQ ID NO: 407295 - DNA, 3852 bp, Homo sapiens
aaggctaaaaactccactagtcggaagtgacgtgccagcttagccccgcaggtccgccacgtaatttgccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacacctcgccggccggggcgccagtccagcgcctgcgggcaatgggcttcagcgctcgagcagcgcatgcgcgggcctgtatctccagaggattcctcgggtcacctggacgccagcatctcagccacctgccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 407296 - DNA, 3553 bp, Homo sapiens
  misc_feature (3495)..(3495): n is a, c, g, or t
aaggctaaaaactccactagtcggaagtgacgtgccagcttagccccgcaggtccgccacgtaatttgccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacacctcgccggccggggcgccagtccagcgcctgcgggcaatgggcttcagcgctcgagcagcgcatgcgcgggcctgtatctccagaggattcctcgggtcacctggacgccagcatctcagccacctgccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagatccgtcctggtgccttactgtgcatacagttctactcgtctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttgntgttgtggcacccacttgcttcctttcggaaggtagatcggtgcgccaaatttggctt

SEQ ID NO: 407297 - DNA, 3697 bp, Homo sapiens
aaggctaaaaactccactagtcggaagtgacgtgccagcttagccccgcaggtccgccacgtaatttgccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacacctcgccggccggggcgccagtccagcgcctgcgggcaatgggcttcagcgctcgagcagcgcatgcgcgggcctgtatctccagaggattcctcgggtcacctggacgccagcatctcagccacctgccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 407298 - DNA, 3167 bp, Homo sapiens
tacctcccagcaccggaagccgggaacgatgccttgtcttgtctgtgagaatcgtatgtcaagctgaggatacagagtcctggacctatcgattctaagatatcactgcaatgagcctggctcgaggagaagttagtgctgatgctaaagcattgatcgcgaagttgcgtatctccttgtactaatcaatgagaggagcacgtagtctataaacagtggtatgtgccagagcaagacgttctgattccgaggtcagggccccgtctgtggcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtga

SEQ ID NO: 407299 - DNA, 1700 bp, Homo sapiens
aaggctaaaaactccactagtcggaagtgacgtgccagcttagccccgcaggtccgccacgtaatttgccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacacctcgccggccggggcgccagtccagcgcctgcgggcaatgggcttcagcgctcgagcagcgcatgcgcgggcctgtatctccagaggattcctcgggtcacctggacgccagcatctcagccacctgccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcaactacaccttgtacttctctacatagtgagataaatgataatgtcagagggagatgaagagaggaccaggcgggaacctagat

SEQ ID NO: 407300 - DNA, 1103 bp, Homo sapiens
gcatgtgcggtgaggctcgcggccggagtgcggcgctgggcggaacctaccatggcggccgagagaaagacaaagttgtccaagaatctgctgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatgtttattatgtcaagccaattcgtacatacaatttggaatcaagtgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacata

SEQ ID NO: 407301 - DNA, 590 bp, Homo sapiens
gggacgggtgttagaaaatggccctaattactggattctgaaacactgaatacactccccctaggaaaaggttttaaactattatcactcttttaagccttagaaaaactagttaagactgatttctcatcttttattccttctcctcttgctaaaaagaagagattacacatttaaaaaaaaaaaggtcagaggataattatcacaaaaaggtttatgtgaaagagttggaggagagaccctgtggtgcatggatgttacatgggatgcattatccactctaaagttttaggagggtaaggctgaggtgcagattccctccattaaacagggccagccttccacttctcccacctcctccactcaccaccaccaccaccaagagatgcatttaaaattattgctgacgactagtgtttcttccatatggcttaaagatgggtgggggaagttcagggaaaatctgaaagtttattatttcttcccccactcaccggaatgtgtcagcagtatgcctgctttaaatatgagtaactaatactaagatttatgatcttaaatacactttaaattcaccctaagtataattc

SEQ ID NO: 407302 - DNA, 752 bp, Homo sapiens
gcatgtgcggtgaggctcgcggccggagtgcggcgctgggcggaacctaccatggcggccgagagaaagacaaagttgtccaagaatctgctgcgcatgaagtttatgcaaaggggactggactcagaaaccaagaaacaactagaagaagaagaaaagaaaatcattagtgaagagcactggtacttggatttgccagagcttaaagagaaagagtaggtttattaaaattgatactgatgatgcttgtggcattcagaaggaaactcctggtaaatttaactcatcattccggtgacataaagcccatgaaattgtttctgttcagtttattgatttagtagcacaactaaaaaatattaaacctatagaagaaaaaaaaaaaaaaaaaaaaaaaaaaaaaaaaaaaaaaaaaaaaaaaaaaaaaaaaaaaagcggggggggcgcgcctaagaaaaattccccgcggaggggggccccatttttatggcgctcacacccccggttctgtgtgtcaccacagaggtggtgccgccaaaaaggggacgtcgctaatatactagccagagagacggggccgcgtttttacaacaccagcgcgcgcgtcgggcaacaaacgtgtctctctgcgcttctcggggagaggacaccccaactcggtggggcgggcgcctgtgggggccacctccctcgtcgatttgcgcgcgcggccataaaaactgcggggttcggtgtgaacccgcgttttgtcg

SEQ ID NO: 407303 - DNA, 155 bp, Homo sapiens
tggggctttgccttactatttttttgactcagagcttacttctcttacaccattgtggtatcaagtattacagagagtcccttatcaattttgactagttctctagattatttgacttcagtttctctgccttcaggtaagtttgacatcagttc

SEQ ID NO: 407304 - DNA, 997 bp, Homo sapiens
gcatgtgcggtgaggctcgcggccggagtgcggcgctgggcggaacctaccatggcggccgagagaaagacaaagttgtccaagaatctgctgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatgtttattatgtcaagccaattcgtacatacaatttggaatcaagtgtcataagaatttattatataaatttatcaagaataaaaatgcctctccagccttaagta

SEQ ID NO: 407305 - DNA, 1135 bp, Homo sapiens
gcatgtgcggtgaggctcgcggccggagtgcggcgctgggcggaacctaccatggcggccgagagaaagacaaagttgtccaagaatctgctgcgcatgaaggtgcggggacgctgagagagccacgccgggcgtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatgtttattatgtcaagccaattcgtacatacaatttggaatcaagtgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacata

SEQ ID NO: 407306 - DNA, 1049 bp, Homo sapiens
gcatgtgcggtgaggctcgcggccggagtgcggcgctgggcggaacctaccatggcggccgagagaaagacaaagttgtccaagaatctgctgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatgtttattatgtcaagccaattcgtacatacaatttggaatcaagtgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacata

SEQ ID NO: 407307 - DNA, 384 bp, Homo sapiens
tttactgccatattttgagtcaactttctgcagatttgataagagcagctcaagagtttagcagcatttcagaggaaaaataaaaacgaagagcagacttatagatgtacctttgcttctgcctacatttatcgggctcttactgtgcttcagtcatcatattgggacagatgaaggagatgacccagacacccagtccttaaggtctccagaaaagatagatgctcagaaagttcagatgtggtgagtctattggagggagccatggaagcatttaggacagaggcactgattttactggcactcatagaagtctagtagctttacctatgtcagacgggcgaggagttggccaggtggaagaggataagaagggcatttcaa

SEQ ID NO: 407308 - DNA, 507 bp, Homo sapiens
ctaagatttatgatcttaaatacactttaaattcaccctaagtataattcagtggggctttgccttactatttttttgactcagagcttacttctcttacaccattgtggtatcaagtattacagagagtcccttatcaattttgactagttctctagattatttgacttcagtttctctgccttcaggtaagtttgacatcagttcctttcacaagcgttttctagcctgaaggtcagcactggtgtatttttcagaaattgatgcttcagatgaatgctaagcacaaagcagaagaagttgaagatgaaacagtagagcttgatgtgtcagatgaagagatggctagaaggtaaccgtgctgcgcagcagccttctaatctggacctagcattcattggctctcccaggaatgctcctcttaccccacagtccacggcagctttcaagggagtcccccagtaggacgatgactgtgatcggccttctcttaatggcctacggggg

SEQ ID NO: 407309 - DNA, 476 bp, Homo sapiens
gccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatgtttattatgtcaagccaattcgtacatacaatttggaatcaagtgtcataagaatttattatataaatttatcaagaataaaaatgcctctccagccttaagta

SEQ ID NO: 407310 - DNA, 1491 bp, Homo sapiens
gcatgtgcggtgaggctcgcggccggagtgcggcgctgggcggaacctaccatggcggccgagagaaagacaaagttgtccaagaatctgctgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatgtttattatgtcaagccaattcgtacatacaatttggaatcaagtgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacataacacccgaggaacgacgcacaacagagacaagaaagacaaaaaaaaaaaccgcggcgggcgggagcggagcaacaggagccaccaaggggagccacaggcacaagagagcaaccccagcggcccctggacgcaaacggggggccccactacatagggagacaaacataaagaggaaggagacagcaggtcgacgaggtaacaacaggagcgatcggacacgggggaaaaaacgcgtgagaacaaccaggagaaacctagggagaacaccgcaccgcctacacactacggggagagagacaaacacgagccaacaaaaagagcacagaggagacataaagaccgcccaacaaaggaacatacatacaaacgtgagcagtgataaaggcg

SEQ ID NO: 407311 - DNA, 1375 bp, Homo sapiens
gcatgtgcggtgaggctcgcggccggagtgcggcgctgggcggaacctaccatggcggccgagagaaagacaaagttgtccaagaatctgctgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatgtttattatgtcaagccaattcgtacatacaatttggaatcaagtgtcataagaatttattatataaatttatcaagaataaaaatgcctctccagccttaagtaaaaaaaaaaaaaaaaaaaaaaaaaaaaaaaaaaaaaaaaaaaaaaaaaaaaaaaaaaaaagcggggggggcgcgcctaagaaaaattccccgcggaggggggccccatttttatggcgctcacacccccggttctgtgtgtcaccacagaggtggtgccgccaaaaaggggacgtcgctaatatactagccagagagacggggccgcgtttttacaacaccagcgcgcgcgtcgggcaacaaacgtgtctctctgcgcttctcggggagaggacaccccaactcggtggggcgggcgcctgtgggggccacctccctcgtcgatttgcgcgcgcggccataaaaactgcggggttcggtgtgaacccgcgttttgtcg

SEQ ID NO: 407312 - DNA, 1193 bp, Homo sapiens
gcatgtgcggtgaggctcgcggccggagtgcggcgctgggcggaacctaccatggcggccgagagaaagacaaagttgtccaagaatctgctgcgcatgaagtcatcatattgggacagatgaaggagatgacccagacacccagtccttaaggtctccagaaaagatagatgctcagaaagttcagatgtgtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgagaccttggtggggacaattgggaaaaagtttgccagaaagagagaccatgccaattatgaagaagatgaaaatggagacataacaccaattaaagcaaagaagatgttcttaaagccccaggattaagatggatgccttaagcgatggcccaggggtgcttggtggaagtcagcagggcatctggagctcatcccaatggtgtctctatagttattaatactgtaacgtttacttgtaaagagattatcattttagaaacatgctgtttttgaaacagatgtgtgatggatgttgtacatcctttgcttcttggtattcattcagagtggatttttagcccctgatctacaaatgtacattgttacagggctgcttcctaaagattttttttacctcaggtttctcttaatatagttctccagtcactgaccttgaattgacttacataaactactgccaatgtttaaattgcccttatgtttatgtttattatgtcaagccaattcgtacatacaatttggaatcaagtgtcataagaatttattatataaatttatcaagaataaaaatgcctctccagccttaagtatttacatgctcccaggtcattgtcagtttatggtattatgttgttttatttaaagcattgaattgatagaaaaatttgctctgtaataaaaatctactttcacata

SEQ ID NO: 407313 - DNA, 5612 bp, Homo sapiens
  misc_feature (2086)..(2086): n is a, c, g, or t
  misc_feature (2693)..(2693): n is a, c, g, or t
ggggaaagggaggtggagtttccaacagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgatactccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgatgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcantgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacngaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagagtcttactctgtctcccaggctgaagtgcaatggcgcaatcatggctcaccaaaacctccgcctgccagactcgagcagttctgcctcagcctcctgagtagctgggactacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaattaaagttacattcttaaccatgatgtcatccttatttagattcctgaacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaacacagtg

SEQ ID NO: 407314 - DNA, 5514 bp, Homo sapiens
  misc_feature (2140)..(2140): n is a, c, g, or t
  misc_feature (2747)..(2747): n is a, c, g, or t
ggggaaagggaggtggagtttccaacagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgatgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcantgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacngaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaccagaccagctttctccatgcagctctggccatgcgtattggccatgtgaagctaaatttggatttggctgggcttcggaaagaaaaagaagatttactaaagaaattggagtcctcatctgaaatcacaagtttggcagaagaaaattcccagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaattaaagttacattcttaaccatgatgtcatccttatttagattcctgaacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaacacagtg

SEQ ID NO: 407315 - DNA, 3622 bp, Homo sapiens
  misc_feature (39)..(39): n is a, c, g, or t
  misc_feature (147)..(147): n is a, c, g, or t
  misc_feature (211)..(211): n is a, c, g, or t
  misc_feature (818)..(818): n is a, c, g, or t
agaagaattagatgaacttaaagtacatatatctatgtnggaattcgaagaaaggggaggggcacccaaaaaggcaatacaagaattgaatagatgtgggcaaacaggagaaggggggaagtcaaagggggtggggaatgggtcatntgaaaagaaatactccagagaagaatggaaaagaaatgttggagcagacattacagaaggtcantgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacngaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaattaaagttacattcttaaccatgatgtcatccttatttagattcctgaacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaacacagtg

SEQ ID NO: 407316 - DNA, 241 bp, Homo sapiens
caaagttgcagacatctaacttctaatggtttaataatatttagtatgtttttgaactgaagaaaatatagagttttaataatcttttttgtgtttcttttacagcttccttttgcctcatatttactagaagcagtactggaaaaaataaatgaaaaaaagaaactagttgaaggatatttcacaattatgaaagatattagatgatattaaaatggagagctttattgcaaatgtgaaa

SEQ ID NO: 407317 - DNA, 5666 bp, Homo sapiens
  misc_feature (2140)..(2140): n is a, c, g, or t
  misc_feature (2747)..(2747): n is a, c, g, or t
ggggaaagggaggtggagtttccaacagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgatgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcantgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacngaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagagtcttactctgtctcccaggctgaagtgcaatggcgcaatcatggctcaccaaaacctccgcctgccagactcgagcagttctgcctcagcctcctgagtagctgggactacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaattaaagttacattcttaaccatgatgtcatccttatttagattcctgaacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaacacagtg

SEQ ID NO: 407318 - DNA, 5551 bp, Homo sapiens
  misc_feature (2140)..(2140): n is a, c, g, or t
  misc_feature (2747)..(2747): n is a, c, g, or t
ggggaaagggaggtggagtttccaacagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgatgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcantgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacngaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaattaaagttacattcttaaccatgatgtcatccttatttagattcctgaacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaacacagtg

SEQ ID NO: 407319 - DNA, 2470 bp, Homo sapiens
ggggaaagggaggtggagtttccaacagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaaggaggccaccggaagatgtgtaccaccaaaacgaagaatataccaaaaaagataaaaagttgggattgagaaaatgtgagatccaacacatgaataatataaagatattccaaggtgaagatgaaagaagattgagaagacttggtagcagtagttctcaatgaagcaggactacagcagttctttaagaaggatgactctgaaaaaattagcagtgatagattgtaatgtttttgagaaagatatttcatactttttgagaattttagaaaggattagtgataagtaaacagaaaactgcacaaataaaagtgacataatttttgttttttaaaaaaggtaaaagagctttattaacatttctctccattacattaattaacacaactactaaatcatcacttacttgcaggattccaaatgtgatgccatattgattgtaaggggtatgtgtaagtttcttgagagttcctactctagatgagttcactttaaaaaaattcttttcaatatcctgttctttctcatctctcagttttgcctcttatctttcacatgaggaatgagaaaagctgtctatactgattttcttttgagatccacacacaattcaaggaccaaaaggtcagcataaatttatgcttctcttagcaagcatgtgtttaatgtcagaaggaagggaaggtgcataggctgttaaggcctgatagaacctaaaaggcagaatataccaaaggtatttgtaggggcactagaatgcaagcaagacattttctgctctgatgttaacagttgtcagtaagtgaaaaattctacaatgaggtatagcatgtgtatcttcacggtgagattaatgcagtcagctaaacagtgaggttgttaataacagagtgatgcaatttttaactgttcagaaaaaacaaaaagttatatatgaaaggaagtgtcatcatagtacaccgtgttgcttagctgtgaaccatacataataagtattatgttaaaaaactagactaaaaatcaggatttacacctgccatgtaaacactggtcagacggcacagcccccagaagtgctggggtagtgtaccctgaggaaaactcacagagaggggctccctgggcaagtgtgtaggtactccattgtcctcttccttctggggcagtataaagcagtctgacaagattacacatgtcagactctgggaaaattaccccgtcacttctggtatgatgagagactgggagacacattataaaatgtatataatagtttttgctattcaaatatgtttatttcctgagtgtgactagtaaaaagttagataataaggcatgttgagttattggaatcctcttttgattctatgtgttggttagcagatagcaaatattataatagcaagggatactagccctctcaaacacacaaaagaaaatctgtctaaatgtgtttagatccaagcgctatcaatgttgggaggaaatgggtaagaaggaaaaagattatgttcctgtctttcttgatgttagttagcaaagaaagtaaaaaaagaaaaaagttatatccccaaatttaagaaataagtaatatatgacctaatgaatacatttatggatggtacttgggactgcttttttggtggtggtggttgttttttggttatgtcttaataactgtgtttaagttgaaaaaataacatgtaacttggatgatattaagaattaaataaaaatatgtgactgttcatgctgattctgtatgtgatcttcgattaatttgacagttgcatataagttagcataggctgttaaggcctgatagaacctaaaaggcagaatataccaaaggtatttgtaggggcactagaatgcaagcaagacattttctgctctgatgttaacagttgtcagtaagtgaaaaattctacaatgaggtatagcatgtgtatcttcacggtgagat

SEQ ID NO: 407320 - DNA, 367 bp, Homo sapiens
agaaggcaggagcctctacagcagctgccttcacatctaggtattggcacatgactgcgttttgtgaggggctcctgtatgtcaggtcctgtgtttgataggaactctagctatgtcctgatagaggtgataggaaatgttgtttgttttaaagttttctccgttattataatattatatagtgaatttggaaaatgtggaaaggtagaaggaagaatttcatcaacctcaagtttctatatttgctgtttctatagcaatttgatgtatttatttccagaccttgttactctttttttttttttttaaagacggagtctctctattgcccaggatggagtgcaatggtgcaatctcggctcactgc

SEQ ID NO: 407321 - DNA, 723 bp, Homo sapiens
gataatggatttttatagtttataatgtattttttaaataggtgccccttaccagattgaggaagttcccttcaatttctagtttgctgagagctttttatcatgaatggatgttggattttgtcatatgctatttttacatctatgaagatgattgctatggtttgaatgtttgttgcctccaaaactcatgttgaaaattaattcctaatggcaatattgagaggtggggtttttaagaggtgactgggtcatgagggctctgctctcatgaatggatgaacctattcatggattggtgagttaatcgattaatgggttatcacaggattgggactgatgactttataagaagaagagaggcctcaactagcacatttgcatgttcagcccacttgccatttgatgccctgcaaagcctcggaattcagcagagtccccaccagcaagaaggccctcaatagacacagccctttgaggctggacttctcaacctccaaaacggtaagaaataaattccttttccttgtaaattactgaatttcaaggtattctgttataaacaacagaaagtgaactaagacaatgatcatacggtctttcattttttctgttaatatggtgaattaacaggtagaaagaaatcctaatcatcatttttgtatatcattatatttgatttgttaatattttattaaaatttttgtatctatgtatggaaaa

SEQ ID NO: 407322 - DNA, 466 bp, Homo sapiens
gaagttgcacaaaatgtacagaaaagtcctgtgtagacttcacccagcccctcccagtgttaacatcttaggattgggactgatgactttataagaagaagagaggcctcaactagcacatttgcatgttcagcccacttgccatttgatgccctgcaaagcctcggaattcagcagagtccccaccagcaagaaggccctcaatagacacagccctttgaggctggacttctcaacctccaaaacggtaagaaataaattccttttccttgtaaattactgaatttcaaggtattctgttataaacaacagaaagtgaactaagacaatgatcatacggtctttcattttttctgttaatatggtgaattaacaggtagaaagaaatcctaatcatcatttttgtatatcattatatttgatttgttaatattttattaaaatttttgtatctatgtatggaaaa

SEQ ID NO: 407323 - DNA, 891 bp, Homo sapiens
acacacacacacatatatgtagtaggacggacagatattaaaagagggattacagacacagtgtacattttagaagtgtaaaacaaggggatttccccagcttggtttcttcccagttcatcctcactttgtgttcctttcctggcttttcagcatggtcatttagccctgctttagcttggtgtcatcgcaaacttagtgggcctgcccccctgtcatgtggaatatgaaaaggggaatatggtatagtgtaaagaacactggactaggaattggaagatggggtgggtcaaatgtgataatatgggtacaataactgaatattatgaagtgctacacagacataccacattcaggcgacttacttaattggaatttgaagctggtctctggcttccattcaagaagcaaaactgtctttgaggagaagttggcatttttctggtgagttacctgcccttttccaaggattttttttgagctgggagaatagcctgtggtactaaagaactttgccaggcattatggaatttttccctgtctgccaggccagagttcctgctctgtgtccagaaggatgtttttctattggtctgttccataacaggatccacagctgagttatacttggcaaaatcaaatgcagatgtgagggctgtgtggtatcacctttttagctttatctctgggcagctcaaaggactgaggctggttgctctcacccatcgctgtttgacataacctcctgattctattattgtcacagcattaacctccacagtaaaacgatctgcagacaacctttgggaataaaataagttaattacttcaggatcatgagtaccaaaactttcaggcagttccccgaaagagctggtacattttatttaa

SEQ ID NO: 407324 - DNA, 567 bp, Homo sapiens
tatgaagtgctacacagacataccacattcaggcgacttacttaattggaatttgaagctggtctctggcttccattcaagaagcaaaactgtctttgaggagaagttggcatttttctggtgagttacctgcccttttccaaggattttttttgagctgggagaatagcctgtggtactaaagaactttgccaggcattatggaatttttccctgtctgccaggccagagttcctgctctgtgtccagaaggatgtttttctattggtctgttccataacaggatccacagctgagttatacttggcaaaatcaaatgcagatgtgagggctgtgtggtatcacctttttagctttatctctgggcagctcaaaggactgaggctggttgctctcacccatcgctgtttgacataacctcctgattctattattgtcacagcattaacctccacagtaaaacgatctgcagacaacctttgggaataaaataagttaattacttcaggatcatgagtaccaaaactttcaggcagttccccgaaagagctggtacattttatttaa

SEQ ID NO: 407325 - DNA, 499 bp, Homo sapiens
atacatacatacacacacacacacacacacacacacatatatgtagtaggacggacagatattaaaagagggattacagacacagtgtacattttagaagtgtaaaacaaggggatttccccagcttggtttcttcccagttcatcctcactttgtgttcctttcctggcttttcagcatggtcatttagccctgctttagcttggtgtcatcgcaaacttagtgggcctgcccccctgtcatgtggaatatgaaaaggggaatatggtatagtgtaaagaacactggactaggaattggaagatggggtgggtcaaatgtgataatatgggtacaataactgaatattatgaagtgctacacagacataccacattcaggcgacttacttaattggaatttgaagctggtctctggcttccattcaagaagcaaaactgtctttgaggagaagttggcatttttctggtgagttacctgcccttttccaaggattttt

SEQ ID NO: 407326 - DNA, 2610 bp, Homo sapiens
ggcccatgcaagtccaaaattcagcagggcagtcaaattttaaacctccaaaatgatcacctttgactccacgtctcacaatcatctctctcaagttcgaagttccacaaatctctaaggcaagggaaagatgctgccagtctctttgctaaaacacagcaagagtcacctttactccagttcccaaaaagtttttcatctccatctgagaccacctcagcctgaattttattgtcaatattgctatcagcattttgggcaaagccattcagcaagtatctaggaagttccaaactttcccacattttcctgtcttcttctgagcccttcaaactgttccaacctctgcctgttacccagttccaaacttgctttcatatttttggctatcttttcagcaatgccccactctactgttagcagtttactgtattagtctgttttcacactgctgataaagacattcctcaagattgtgaagaaaaagaggtttaattggacttacagttccacatggccggggaggcctcagaatcatggcgggaggtgaaaagcacttcgtacatggtggtggcaagagaaaatgaagaagaagcaaaagtggaaacccctgataaacccatcagatctcatgagacttactatcatgagaatagcacaggaaagactggcccccctgattcgatgacctccccctgggtccctcccacaacatgtgggaattccagaagataaattcaagttgcaatttcagtggggacatagccaaaccaggcgccaggtagctcctgcccttagcccaggaggccatccctgcggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagttgaccagctaatctggcttctgtgtctttttgaaatggctcagacctgtttctccaagaagacctagttccctttagtagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggttgcagtgagctgagatcatgctactgcagtccagcctgggctacagagtgagactgcatctcaaaaaaaacccaaaaaacaaaaacaaacaacaacaacaaaattataaaggtagaaaataaacctaaattgtgtcgtaattaagattattaaaattagaattatacaatgacttatttttggtggcaaatactttaggagcaataatgccttatggtaattattgatgtatagtttcttttgtttatgaagtcaaatttgtataaattctcttaattcaaaaaaaaa

SEQ ID NO: 407327 - DNA, 2531 bp, Homo sapiens
ctagtcgaggacggcgtgtaattcggccgagggtctgcggcgattgagtggtgggctagctcgccgcttcggctctggctgctgttgttcctcctgccctcagcgcagggcgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcaggtaagacatcagagtaccatgatatcatgtatcctgcttggacatttgggaagggggacctgctgtttggccaatttatcctacaggtcttggacggtgggacctcttcagagaagatctggtaaggtcagcagcacagtggccatgggaaaaagaaaaactcagcagcacagtggccatggaaatatgctgtaggaatgtccctgagacccagaagggcctgcgctcagctgctctggcaccccgctgcagggatggcctcctgggctaagggcaggagctacctggcgcctggtttgctgcagggccaagtggccatcgtcaccggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggttgcagtgagctgagatcatgctactgcagtccagcctgggctacagagtgagactgcatctcaaaaaaaacccaaaaaacaaaaacaaacaacaacaacaaaattataaaggtagaaaataaacctaaattgtgtcgtaattaagattattaaaattagaattatacaatgacttatttttggtggcaaatactttaggagcaataatgccttatggtaattattgatgtatagtttcttttgtttatgaagtcaaatttgtataaattctcttaattcaaaaaaaaa

SEQ ID NO: 407328 - DNA, 1830 bp, Homo sapiens
ctagtcgaggacggcgtgtaattcggccgagggtctgcggcgattgagtggtgggctagctcgccgcttcggctctggctgctgttgttcctcctgccctcagcgcagggcgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcaggtaagacatcagagtaccatgatatcatgtatcctgcttggacatttgggaagggggacctgctgtttggccaatttatcctacaggtcttggacggtgggacctcttcagagaagatctggtaaggtcagcagcacagtggccatgggaaaaagaaaaactcagcagcacagtggccatggaaatatgctgtaggaatgtccctgagacccagaagggcctgcgctcagctgctctggcaccccgctgcagggatggcctcctgggctaagggcaggagctacctggcgcctggtttgctgcagggccaagtggccatcgtcaccggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtccc

SEQ ID NO: 407329 - DNA, 2552 bp, Homo sapiens
ctagtcgaggacggcgtgtaattcggccgagggtctgcggcgattgagtggtgggctagctcgccgcttcggctctggctgctgttgttcctcctgccctcagcgcagggcgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcaggtaagacatcagagtaccatgatatcatgtatcctgcttggacatttgggaagggggacctgctgtttggccaatttatcctacaggtcttggacggtgggacctcttcagagaagatctggtaaggtcagcagcacagtggccatgggaaaaagaaaaactcagcagcacagtggccatggaaatatgctgtaggaatgtccctgagacccagaagggcctgcgctcagctgctctggcaccccgctgcagggatggcctcctgggctaagggcaggagctacctggcgcctggtttgctgcagggccaagtggccatcgtcaccggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggttgcagtgagctgagatcatgctactgcagtccagcctgggctacagagtgagactgcatctcaaaaaaaacccaaaaaacaaaaacaaacaacaacaacaaaattataaaggtagaaaataaacctaaattgtgtcgtaattaagattattaaaattagaattatacaatgacttatttttggtggcaaatactttaggagcaataatgccttatggtaattattgatgtatagtttcttttgtttatgaagtcaaatttgtataaattctcttaattcaaaaaaaaaaaagtcgacgcggccgcgaat

SEQ ID NO: 407330 - DNA, 1518 bp, Homo sapiens
cactctagctgttcttaactctccagtgagagagtgcctctcaagtcatgccagcaaaaacaatattaatggtgccagcaggtcccagagaggatactcattaactgaccctgcctggttatgtgttcagtcattaaccaaaaactgtagaaatgaggttgctctgctatgcatggtcagcctgaggaatgaggaactgtggtcatcatcgctcagacatggactgagaacaggcaagaggcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggttgcagtgagctgagatcatgctactgcagtccagcctgggctacagagtgagactgcatctcaaaaaaaacccaaaaaacaaaaacaaacaacaacaacaaaattataaaggtagaaaataaacctaaattgtgtcgtaattaagattattaaaattagaattatacaatgacttatttttggtggcaaatactttaggagcaataatgccttatggtaattattgatgtatagtttcttttgtttatgaagtcaaatttgtataaattctcttaattcaaaaaaaaa

SEQ ID NO: 407331 - DNA, 1424 bp, Homo sapiens
ctagtcgaggacggcgtgtaattcggccgagggtctgcggcgattgagtggtgggctagctcgccgcttcggctctggctgctgttgttcctcctgccctcagcgcagggcgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcaggtaagacatcagagtaccatgatatcatgtatcctgcttggacatttgggaagggggacctgctgtttggccaatttatcctacaggtcttggacggtgggacctcttcagagaagatctggtaaggtcagcagcacagtggccatgggaaaaagaaaaactcagcagcacagtggccatggaaatatgctgtaggaatgtccctgagacccagaagggcctgcgctcagctgctctggcaccccgctgcagggatggcctcctgggctaagggcaggagctacctggcgcctggtttgctgcagggccaagtggccatcgtcaccggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcaggcaaatcagcaatgtcttaccaatccaagataccttgctaacaactgtcaattaaaagtctacagaattgaaattcagccatgatttttattagccaaaactgaattaaagaatacaaggctggccgggcatggtggctcatgcctgtaatcccagcactttgggaggccgaggcgggcggattacctgagctcaggagtttgagaccagcctgggcaacacggtgaaaccccgtctctactaagatacaaaa

SEQ ID NO: 407332 - DNA, 1922 bp, Homo sapiens
  misc_feature (22)..(22): n is a, c, g, or t
  misc_feature (30)..(30): n is a, c, g, or t
  misc_feature (35)..(36): n is a, c, g, or t
  misc_feature (59)..(59): n is a, c, g, or t
aaaaaagccaaggccgttgggnttaacccnggganntcccggcgcacaaatttcccccngggggcaagttcttggacgagaatgtccctgagacccagaagggcctgcgctcagctgctctggcaccccgctgcagggatggcctcctgggctaagggcaggagctacctggcgcctggtttgctgcagggccaagtggccatcgtcaccggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggttgcagtgagctgagatcatgctactgcagtccagcctgggctacagagtgagactgcatctcaaaaaaaacccaaaaaacaaaaacaaacaacaacaacaaaattataaaggtagaaaataaacctaaattgtgtcgtaattaagattattaaaattagaattatacaatgacttatttttggtggcaaatactttaggagcaataatgccttatggtaattattgatgtatagtttcttttgtttatgaagtcaaatttgtataaattctcttaattcaaaaaaaaa

SEQ ID NO: 407333 - DNA, 1868 bp, Homo sapiens
  misc_feature (22)..(22): n is a, c, g, or t
  misc_feature (30)..(30): n is a, c, g, or t
  misc_feature (35)..(36): n is a, c, g, or t
  misc_feature (59)..(59): n is a, c, g, or t
aaaaaagccaaggccgttgggnttaacccnggganntcccggcgcacaaatttcccccngggggcaagttcttggacgagaatgtccctgagacccagaagggcctgcgctcagctgctctggcaccccgctgcagggatggcctcctgggctaagggcaggagctacctggcgcctggtttgctgcagggccaagtggccatcgtcaccggcggggccacgggcatcggccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggttgcagtgagctgagatcatgctactgcagtccagcctgggctacagagtgagactgcatctcaaaaaaaacccaaaaaacaaaaacaaacaacaacaacaaaattataaaggtagaaaataaacctaaattgtgtcgtaattaagattattaaaattagaattatacaatgacttatttttggtggcaaatactttaggagcaataatgccttatggtaattattgatgtatagtttcttttgtttatgaagtcaaatttgtataaattctcttaattcaaaaaaaaa

SEQ ID NO: 407334 - DNA, 307 bp, Homo sapiens
ctcaagatactttatcaacaagtgcatattttcaggtactacatagcaggctcatttagtacaactgagttttcacagagtgatagctgttgccacatcacttttgtgaatgggagatttaatttggtttgtaaaggattctttgtgatgacttaaatgtacggggtattttttaggaatattttcaaatgtaaatgttgttactaagaactacaatcaatctgtagtgttgagtaatttcaaatgtaaaatttatgtaacaatgcagtgcagataccaaaataggggttggtggcctgaaatacaa

SEQ ID NO: 407335 - DNA, 684 bp, Homo sapiens
ggtcaggagtttgagaccagcctggccaacatggcgaaaccccatctctactaaaaatacaaaaagtagccgggtatggtggtgggcgcctttaatcccagctacttggtaggcaggatggtctcgatctcctgatcttgtcatccatccgccttggcctcctaaaatgctggggttacaggcgtgacccactgcatctggccagtgggtattttttttaacatacatagctttcaagggctttctgaaacattagttgaactcagtttttgtctcctgacaacatatactacccctctcttaggcttttctgtgcaggcacccccaacaactactgtaggtggtggggacttaaccttattgcaggtttctccacttacatcttgttgattatgtaatatgaacaactgatacgctgtctcaaagaagctgagtcacttagaatgtttttctcctgttttttccttttccttcagaggaagaagagcttagaagaacagctccatcaccttgtaagttgagccttagaaattcatggcaacatgacttagttttttatagtggttttctagagttcattgattttacataataatatatttgtatcagtcataaagttcattttgaggagatgtaaacctttaacatattcgtgttacccatttttcttaaaatcttaaacat

SEQ ID NO: 407336 - DNA, 288 bp, Homo sapiens
ctgatctatgagatcccctggaatcttcccgtgggaaaagtggcagtggatgagtagtgagagcttacgatgtgaagaacttcatcttcatgcagaaaatctgtctaggcgggtctgggagctactgatgcttcttcctacatgtcctaatatgttgatggcattccagaatatctcagatgagcagagtaatgatggatttaattggaaagaacttctcaaaattaagagcgcccacaagctattgtatgctctggaaattattgaagcactgggaaaacctaatag

SEQ ID NO: 407337 - DNA, 4400 bp, Homo sapiens
ccccccccactcctatagatcagtcaaaaatctgttcttaagtccatatgagttattaattaaaagtagacttattttctttggaagcaaaagaatgattatctgaaatgtttgcatttgtagctcttggctttattttgaactgttggctttaatactggtttagcattattcataattttaaaatttcttttttatttcagtatcagatgtagaaggtggtgatggactgcagctcagaaaggaacatactctcaaaatatttacttacatcaattcctggacacagaggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcacgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggtagcctttcagtgtcaaattttctctttctctttctctctttctttctttttctcttttttttctttttctttctcttttctcctttccttttcttttattctccttttcttttctttcttggttatatcatatagcaactgtcttggtttgtcttgtgttgctgtaacaatactacagactaggtaaagaacagaatttgggaagtccaagatcagggtaccagcatctggtgagggctcctctctgctttcaaagtggcaccttgaatgctgcctcctcacaggcagagggtggaagggtaaaaaatgaacagactccctccatcagacccttttataatggcattaattcattcatggcctctccaaagaccccacatctaaaacctgttgcattggagattaatgttcaacatgaat

SEQ ID NO: 407338 - DNA, 5670 bp, Homo sapiens
ccccccccactcctatagatcagtcaaaaatctgttcttaagtccatatgagttattaattaaaagtagacttattttctttggaagcaaaagaatgattatctgaaatgtttgcatttgtagctcttggctttattttgaactgttggctttaatactggtttagcattattcataattttaaaatttcttttttatttcagtatcagatgtagaaggtggtgatggactgcagctcagaaaggaacatactctcaaaatatttacttacatcaattcctggacacagaggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcacgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagtttgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtgaatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacggccaaactgtatcacattgtatgtggatatgttaatttttttaaacatacagacataaaaattgctagaaattaccgacaagaaaagcaaattttgaataaattgaattctggaaatataaaacgggcttgtttttagaatacaaaatcagatgttaattcctgtgactgactgaatatagaaaggtaacctaaggctgggcacggtggctcgtgcctatagtcctggcactttgagtggctgaggtgggtggattgcttgaaaccaggagttcgagaccagccaaggcaacatggtgaaacctcatccctacagaaaatacaaaaatttgctgggtgtggtggcacacacctgtagtctcagctactcgggaggctgaggtgggaggattgcttgagctcaggaggtcgaggcttcagtgagccatgatcacaccactgcactgtagcctaggtgacagaaggagaacgtgtctc

SEQ ID NO: 407339 - DNA, 4516 bp, Homo sapiens
ccccccccactcctatagatcagtcaaaaatctgttcttaagtccatatgagttattaattaaaagtagacttattttctttggaagcaaaagaatgattatctgaaatgtttgcatttgtagctcttggctttattttgaactgttggctttaatactggtttagcattattcataattttaaaatttcttttttatttcagtatcagatgtagaaggtggtgatggactgcagctcagaaaggaacatactctcaaaatatttacttacatcaattcctggacacagaggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcacgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagtaatgatggatttaattggaaagaacttctcaaaattaagagcgcccacaagctattgtatgctctggaaattattgaagcactgggaaaacctaatag

SEQ ID NO: 407340 - DNA, 2127 bp, Homo sapiens
taaaaaattataaattatgagcagtatgttttttcaaaaatctcatagctattacatatatttttatattgccttcattaaagaaatgaaagtgtcatttccatttcattaaatacatcttgtataccctctttatttctagatactttttcttcatttttataagattgaattggtactgaccataatatttgagcagcagaatttttatagtacatgattaagtactagctataattatttttattttctggtcttttaatttcaaaattgtattgtggccattctaaattaatgaaaatagggaattgactatttcttctcatttacagtggcagctagactgtcttgcttgcttgctgaagttaatatgccagtttgcagtagatccatccgatttggatttagcttatcatgatgtctttgcctggtctggtatagcggaaagccataggaaaagaacctggcctggcaaatcaaggaaggctgctggtgatcatgctaagggtcttcatataccacgattaacagaggtatttcttgttcttgtccaaggaaccagtttgattcagcgacttatgtctgttgcttatacgtatgataatctggctcctagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagtttgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtgaatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacggccaaactgtatcacattgtatgtggatatgttaatttttttaaacatacagacataaaaattgctagaaattaccgacaagaaaagcaaattttgaataaattgaattctggaaatataaaacgggcttgtttttagaatacaaaatcagatgttaattcctgtgactgactgaatatagaaaggtaacctaaggctgggcacggtggctcgtgcctatagtcctggcactttgagtggctgaggtgggtggattgcttgaaaccaggagttcgagaccagccaaggcaacatggtgaaacctcatccctacagaaaatacaaaaatttgctgggtgtggtggcacacacctgtagtctcagctactcgggaggctgaggtgggaggattgcttgagctcaggaggtcgaggcttcagtgagccatgatcacaccactgcactgtagcctaggtgacagaaggagaacgtgtctc

SEQ ID NO: 407341 - DNA, 463 bp, Homo sapiens
gtaaaatttgatgtgaaattgacatttatattgtcgaggaaagataaaagacataattatgtgaactatcttgcttgtgtgtattttttttcttttttgtagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtgaatggcggcaggc

SEQ ID NO: 407342 - DNA, 5842 bp, Homo sapiens
attctcttgctccccgccccgtcgggatcagtcagtgtgatccgaagcgggggagggggggggcggcggccgaacgatgtgcgagaactgcgcagacctggtggaggtgttaaatgaaatatcagatgtagaaggtggtgatggactgcagctcagaaaggaacatactctcaaaatatttacttacatcaattcctggacacagaggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcacgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagtttgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtgaatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacggccaaactgtatcacattgtatgtggatatgttaatttttttaaacatacagacataaaaattgctagaaattaccgacaagaaaagcaaattttgaataaattgaattctggaaatataaaacgggcttgtttttagaatacaaaatcagatgttaattcctgtgactgactgaatatagaaaggtaacctaaggctgggcacggtggctcgtgcctatagtcctggcactttgagtggctgaggtgggtggattgcttgaaaccaggagttcgagaccagccaaggcaacatggtgaaacctcatccctacagaaaatacaaaaatttgctgggtgtggtggcacacacctgtagtctcagctactcgggaggctgaggtgggaggattgcttgagctcaggaggtcgaggcttcagtgagccatgatcacaccactgcactgtagcctaggtgacagaaggagaacgtgtctc

SEQ ID NO: 407343 - DNA, 5926 bp, Homo sapiens
ccccccccactcctatagatcagtcaaaaatctgttcttaagtccatatgagttattaattaaaagtagacttattttctttggaagcaaaagaatgattatctgaaatgtttgcatttgtagctcttggctttattttgaactgttggctttaatactggtttagcattattcataattttaaaatttcttttttatttcagtatcagatgtagaaggtggtgatggactgcagctcagaaaggaacatactctcaaaatatttacttacatcaattcctggacacagaggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcacgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagtttgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtgaatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacggccaaactgtatcacattgtatgtggatatgttaatttttttaaacatacagacataaaaattgctagaaattaccgacaagaaaagcaaattttgaataaattgaattctggaaatataaaacgggcttgtttttagaatacaaaatcagatgttaattcctgtgactgactgaatatagaaaggtaacctaaggctgggcacggtggctcgtgcctatagtcctggcactttgagtggctgaggtgggtggattgcttgaaaccaggagttcgagaccagccaaggcaacatggtgaaacctcatccctacagaaaatacaaaaatttgctgggtgtggtggcacacacctgtagtctcagctactcgggaggctgaggtgggaggattgcttgagctcaggaggtcgaggcttcagtgagccatgatcacaccactgcactgtagcctaggtgacagaaggagaacgtgtctc

SEQ ID NO: 407344 - DNA, 5220 bp, Homo sapiens
cctaagtggaactgctccggtggctttttccccatgtctgagtgctgctcatccaaaagcatagttgttttttggggttttctttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcacgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagtttgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtgaatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacggccaaactgtatcacattgtatgtggatatgttaatttttttaaacatacagacataaaaattgctagaaattaccgacaagaaaagcaaattttgaataaattgaattctggaaatataaaacgggcttgtttttagaatacaaaatcagatgttaattcctgtgactgactgaatatagaaaggtaacctaaggctgggcacggtggctcgtgcctatagtcctggcactttgagtggctgaggtgggtggattgcttgaaaccaggagttcgagaccagccaaggcaacatggtgaaacctcatccctacagaaaatacaaaaatttgctgggtgtggtggcacacacctgtagtctcagctactcgggaggctgaggtgggaggattgcttgagctcaggaggtcgaggcttcagtgagccatgatcacaccactgcactgtagcctaggtgacagaaggagaacgtgtctc

SEQ ID NO: 407345 - DNA, 1952 bp, Homo sapiens
tctttatccagattcagatgattcaagtgaggatcaagtggaaaatagtaaaaattcctggagttgcaagtttgttgctgctggagggcttcaacagttattagaaatttttaattctggaattctagagcctaaagagcaggaatcatggactgtgtggcagctagactgtcttgcttgcttgctgaagttaatatgccagtttgcagtagatccatccgatttggatttagcttatcatgatgtctttgcctggtctggtatagcggaaagccataggaaaagaacctggcctggcaaatcaaggaaggctgctggtgatcatgctaagggtcttcatataccacgattaacagaggtatttcttgttcttgtccaaggaaccagtttgattcagcgacttatgtctgttgcttatacgtatgataatctggctcctagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagtttgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtgaatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacggccaaactgtatcacattgtatgtggatatgttaatttttttaaacatacagacataaaaattgctagaaattaccgacaagaaaagcaaattttgaataaattgaattctggaaatataaaacgggcttgtttttagaatacaaaatcagatgttaattcctgtgactgactgaatatagaaaggtaacctaaggctgggcacggtggctcgtgcctatagtcctggcactttgagtggctgaggtgggtggattgcttgaaaccaggagttcgagaccagccaaggcaacatggtgaaacctcatccctacagaaaatacaaaaatttgctgggtgtggtggcacacacctgtagtctcagctactcgggaggctgaggtgggaggattgcttgagctcaggaggtcgaggcttcagtgagccatgatcacaccactgcactgtagcctaggtgacagaaggagaacgtgtctc

SEQ ID NO: 407346 - DNA, 941 bp, Homo sapiens
gaagaattaacgatatgttaacacaagttgactgtgatagaataattacaataaatatgcctattttcctttggggagaaaagtctaaaattctgctttatagaagctattctcagctctaaaagagcatatatgtagatcttcatttcttttcttctaacaattttaggggaaaatacaaaccttaagttatttcctgaaatatttcccaggatgattactaccttggattttaaggcttctttcttcacaagttctgactcttctataagcacagtcagaatggtcagaatgctgactctcctttaggtagtcagaatgggtcttccaaacctttgtatgagcccattagctgcctcagctttccctcaactttcaggaaaacacaggttacatattctttacgttactatgagaaactacctacattatttttttttaaattttatttttggctgggcacattggctcacacctgcaatcccaacattttgggaggctgagatgaaaggattgcttgaagccaggagttgcaagacaagcctaggtgacaaagtgagaccttgactataaaaaaaaaattaacctttccggcggtgatgacctacccacacgagaacatgcctcttgcaaagggtctccttcatccctctccagaaaaggagaagaggaaacacaagaagaaacgcctggtgcagagccccaattcctgcttcatggatgtgaaatgcccaggatgctataaaatcatcacggtctttagccatgcacaaacggtagttttgtgtgttggctgctccactgtcctctgccagcctacaggaggaaaagcaaggcttacagaaggatgttccttcaggaggaagcagcactaaaagcactctgaatcaagatgagtgggaaaccatctcaataaacacattttggattaaaaaaaaaaa

SEQ ID NO: 407347 - DNA, 590 bp, Homo sapiens
aattagccgggcatggtggcatgcacctgtagtcccagctactctggaggctaaggtgggaggatcgcttgagcctaggagctcaaggttacagtgagctatgatcacatcactgcattccagcctgggtgacaatagccctataatgtaggtagttacttttatctgcattttacaaatgaaaagaactgacagacattgagttaaaataaccagtacaaaaatcacagatgggggatagccaaagctttaaaatggaatagcaggaagttttaatttgcaaatagaatcattaatgtttaatagaatcattaatagatttaatagaattaatgaattgatagaatcattaattcatacttagtttggagtgattgttgaacacatttctcagctaatttaggtcttcattatattttagaacatattatctgcatcattaaaaaattcctcatttcctcattgcctatctctgccttttattcactcagttttaaaataaacagattttgtttatactgcttcttttattaatatttatggtaagatattttatactgctgataaatggacattaatgatatatagcc

SEQ ID NO: 407348 - DNA, 1779 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacagcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaagggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggtaaggaacgtcaccactcctggactcagggctgaaccatcaggaaacaaaatgtttttcttgggtttctgttacctcaagatgagataaagagggacaagcagatgaatgaacacacacacactggtttataaatccaaatgtcaacttatcgataaaccctaagcatcttaaataccaaggagacgagaataatcatatcagctagaaaacagggaaaagtcttgggaaactaaattaaacttaaaaagtgctatggcctgaatgtttgtgtcctctccaaaattcatatgttgagacctaatccccaatgcaatagtattaagaggcggggcctttagcaggtggttaggtcatgagcactctgccctcatgaatgggattagtgcccttataaaagaggcctgagggagcttattttccccttccaccatgggaggacccagctaaaaggtgccatttatgagtcacggagtgggccctcgccagacactgcatccactggctccttgatcttggacttcccagcttccagaactatgagcaaatacatctctgttgtttgtaagtgacccagtttacggtactttgttatagcagcctgcacagactaagacaaaaaaggattcatctttcaaggctgagttgagacctcaatttcaacccaccaccctcaccttatgctactgagttttgacaagctaccaagggagggcgtgcaaatagaaagaagcagcagtcccaggctcagccactgttaagagatcaagaaga

SEQ ID NO: 407349 - DNA, 2752 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacagcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatatgaagaaacatttgaatctgacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaactttaaaaaaaaaaaaaaaaaaaaaaaaaaacgttgtgtgtggggcggcgccttgggccctcggaaaaaagaggtctttctaaaaccacatgtggttgtgggggggggcggcacccacagagaggtaacatgtggaacaattgggccaaaaaacgtggtcgccccagaggagagaacccgcgggcccaagacaataagttggcggtgggtttcccacacgaagtaaaaaaaaaacgccgcgggggggagacagggaggctgctttcggaacacaaatcccaggagagagagtccgggaggggacatcagcggggtcttaaacaaccgaggtgagccaagagaagtccgaataaaatcaccgccggcgagga

SEQ ID NO: 407350 - DNA, 1515 bp, Homo sapiens
gccaggccttacccgagttaccttttgctagtggtgacgtgcacgtcttgcttatgtcatttgccttgatttgatggctaacatgatcttcttaaaggcttaactttttcatgtctgtttctgcacttacccaaatatccagaggaactttcagaagacaaggaggagtttgttggctacggtcagaagttctttataggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaactttaaaaaaaaaaaaaaaaaaaaaaaaaaacgttgtgtgtggggcggcgccttgggccctcggaaaaaagaggtctttctaaaaccacatgtggttgtgggggggggcggcacccacagagaggtaacatgtggaacaattgggccaaaaaacgtggtcgccccagaggagagaacccgcgggcccaagacaataagttggcggtgggtttcccacacgaagtaaaaaaaaaacgccgcgggggggagacagggaggctgctttcggaacacaaatcccaggagagagagtccgggaggggacatcagcggggtcttaaacaaccgaggtgagccaagagaagtccgaataaaatcaccgccggcgagga

SEQ ID NO: 407351 - DNA, 590 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacagcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtaaggagattttattccacaggatagtagagctctgatgtggtgccattttccccacattgctagttcaaatgaattaaaggttctaaggaaaagttttatt

SEQ ID NO: 407352 - DNA, 446 bp, Homo sapiens
aaagatctgtgtcatggacctagagcctcaggtgggtccatggtggaatatttatgtccccaaacaatgaatgcgtatcatccattttttgtgcacatgctgtaggttatagttgagacatttattctgttagccttttaagaataaggccatttcccatatataagatcttacttaacgtgtcaattgacaacattttacttttagttgggaaagaagtcttgcttctcagacagaaaagcagaactgattgagtggtcacaaagagaagcaagaatctttcttgctttaaccttgatcacaaaggcatcagagtaacttcttgtggagtgaataagatgttgctttgtacaaggaggtgaggtttctatgttgtcatatctgtggctaccttcctgagaccacatgtagaatggagcaggggtgagcaagttaaggtaagataa

SEQ ID NO: 407353 - DNA, 2692 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacagcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaactttaaaaaaaaaaaaaaaaaaaaaaaaaaacgttgtgtgtggggcggcgccttgggccctcggaaaaaagaggtctttctaaaaccacatgtggttgtgggggggggcggcacccacagagaggtaacatgtggaacaattgggccaaaaaacgtggtcgccccagaggagagaacccgcgggcccaagacaataagttggcggtgggtttcccacacgaagtaaaaaaaaaacgccgcgggggggagacagggaggctgctttcggaacacaaatcccaggagagagagtccgggaggggacatcagcggggtcttaaacaaccgaggtgagccaagagaagtccgaataaaatcaccgccggcgagga

SEQ ID NO: 407354 - DNA, 2784 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacagcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatatgaagaaacatttgaatctgacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaagttttagtctgtgtgctaccaaagcaagcacaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaactttaaaaaaaaaaaaaaaaaaaaaaaaaaacgttgtgtgtggggcggcgccttgggccctcggaaaaaagaggtctttctaaaaccacatgtggttgtgggggggggcggcacccacagagaggtaacatgtggaacaattgggccaaaaaacgtggtcgccccagaggagagaacccgcgggcccaagacaataagttggcggtgggtttcccacacgaagtaaaaaaaaaacgccgcgggggggagacagggaggctgctttcggaacacaaatcccaggagagagagtccgggaggggacatcagcggggtcttaaacaaccgaggtgagccaagagaagtccgaataaaatcaccgccggcgagga

SEQ ID NO: 407355 - DNA, 1815 bp, Homo sapiens
ttagtatgtgtggctatttaaagtataatgactttggtttggttatatgagtgacacagaatttaaggaggcttcatgccatagttcatagtttgctctaatggcttggtggtatccctgaacagtctacttttagaaattaacagtaaatacacaatccagctgtaatcttaccctccaccagggggagcttcaacatcggttaatactttttttttttttgagatggagtctcgccctgtcgcccaggctagagtgcaatggctcagtctccgctcaccgcaatctctgcctcccgggttcaaacagttgtgcctcagtcttccaagtagctgggattacaggcacccgccaccacgcccagctaatttttgtatttttagtagagacggggtttcatcatgttggcgaggctggtcttgaactcctgacttcgtgatccgcccccccctcagcctcccaaagtgctgggattacaggcgtgagccaccgcgcctggcccggttaatactttcataagcattgaagtaactatttaagtcctagtacataaacactgtgtggttcacaaaaaggcatagagacattctctcaagagtttacaatctaattgggcagggaagatactacagttcatcaaagatatgaataacaccctagttttctgaactgcagctgcatgggtaattatcttaagaacttttggcaaaatatggatgttggtgtgttactctcttctccctacaactctgaactaatctgtgtttggcaccttgatttgccatcataaatggccaccatttactcctcactgaaatattcttcttctttgaggttataatgtacttggaaaagttaatacttatagaaaataatgatctttattaccaactttattaaaacaggcttggaacatttttctccatagaagaatagtaataagacattctacatttcctggacatggccagtttaaaatattttgccccattacccttgtagatacacatgtatttgtcagtttatgtgcctcagttttgtcttaggcactgagggacagaaagagaaataaggaataccttggtattttcctttgcaagcaatcacagcagaatgctagaaaacataaaatatactcttataaattgtatgtgtgttgaaaccaaagtgtgaagaaattgtcaggtatttggaggaggaaaataatttgtaaaataacctttttaagaatttggattttgtacttatttaaggtgctaaatatgtgttaaaatatcccctcttgaatcagctccaggcttaaaagggcagagtggtttggattcttgtccagggtctggaaagagctcatcttgccgagagggaaataaatgtgagctttgaggcggtctaactacccagcttttagtatttatgttccccaaaatgtaaaaactgtaagttattcttgaaaatgtagtccagacatttctttgatcctggattttactgcagtttcatcatgggtttgttgaatgtgcagtccatttattgccctgtcttgcttaaatattcttgttgagaacagctggaggctttgactgggttcctagttctgttttctgggaaggcaacgtggattctgttttgtagacattaatgagctttaaatgggaattggggatgatgtatgttcgttgggcatgctgagaagcggcctcctgtggttctgggcccaaggtgtgacatacatttcccactaattgcttctctcaagaagcaagagattggctgttcctcttgaggaaaaaccttaataaaccttcccattttaaa

SEQ ID NO: 407356 - DNA, 1770 bp, Homo sapiens
  misc_feature (1732)..(1732): n is a, c, g, or t
ttagtatgtgtggctatttaaagtataatgactttggtttggttatatgagtgacacagaatttaaggaggcttcatgccatagttcatagtttgctctaatggcttggtggtatccctgaacagtctacttttagaaattaacagtaaatacacaatccagctgtaatcttaccctccaccagggggagcttcaacatcggttaatactttttttttttttgagatggagtctcgccctgtcgcccaggctagagtgcaatggctcagtctccgctcaccgcaatctctgcctcccgggttcaaacagttgtgcctcagtcttccaagtagctgggattacaggcacccgccaccacgcccagctaatttttgtatttttagtagagacggggtttcatcatgttggcgaggctggtcttgaactcctgacttcgtgatccgcccccccctcagcctcccaaagtgctgggattacaggcgtgagccaccgcgcctggcccggttaatactttcataagcattgaagtaactatttaagtcctagtacataaacactgtgtggttcacaaaaaggcatagagacattctctcaagagtttacaatctaattgggcagggaagatactacagttcatcaaagatatgaataacaccctagttttctgaactgcagctgcatgggtaattatcttaagaacttttggcaaaatatggatgttggtgtgttactctcttctccctacaactctgaactaatctgtgtttggcaccttgatttgccatcataaatggccaccatttactcctcactgaaatattcttcttctttgaggttataatgtacttggaaaagttaatacttatagaaaataatgatctttattaccaactttattaaaacaggcttggaacatttttctccatagaagaatagtaataagacattctacatttcctggacatggccagtttaaaatattttgccccattacccttgtagatacacatgtatttgtcagtttatgtgcctcagttttgtcttaggcactgagggacagaaagagaaataaggaataccttggtattttcctttgcaagcaatcacagcagaatgctagaaaacataaaatatactcttataaattgtatgtgtgttgaaaccaaagtgtgaagaaattgtcaggtatttggaggaggaaaataatttgtaaaataacctttttaagaatttggattttgtacttatttaaggtgctaaatatgtgttaaaatatcccctcttgaatcagctccaggcttaaaagggcagagtggtttggattcttgtccagggtctggaaagagctcatcttgccgagagggaaataaatgtgagctttgaggcggtctaactacccagcttttagtatttatgttccccaaaatgtaaaaactgtaagttattcttgaaaatgtagtccagacatttctttgatcctggattttactgcagtttcatcatgggtttgttgaatgtgcagtccatttattgccctgtcttgcttaaatattcttgttgagaacagctggaggctttgactgggttcctagttctgttttctgggaaggcaacgtggattctgttttgtagacattaatgagctttaaatgggaattggggatgatgtatgtctacaaaaaaaaaaaagttggagcggccgccaacttaggggccacgtgagccaggcacngccgcataggcaagcaccggaagcaccccggcggccgc

SEQ ID NO: 407357 - DNA, 1992 bp, Homo sapiens
  misc_feature (1901)..(1901): n is a, c, g, or t
ttagtatgtgtggctatttaaagtataatgactttggtttggttatatgagtgacacagaatttaaggaggcttcatgccatagttcatagtttgctctaatggcttggtggtatccctgaacagtctacttttagaaattaacagtaaatacacaatccagctgtaatcttaccctccaccagggggagcttcaacatcggttaatactttttttttttttgagatggagtctcgccctgtcgcccaggctagagtgcaatggctcagtctccgctcaccgcaatctctgcctcccgggttcaaacagttgtgcctcagtcttccaagtagctgggattacaggcacccgccaccacgcccagctaatttttgtatttttagtagagacggggtttcatcatgttggcgaggctggtcttgaactcctgacttcgtgatccgcccccccctcagcctcccaaagtgctgggattacaggcgtgagccaccgcgcctggcccggttaatactttcataagcattgaagtaactatttaagtcctagtacataaacactgtgtggttcacaaaaaggcatagagacattctctcaagagtttacaatctaattgggcagggaagatactacagttcatcaaagatatgaataacaccctagttttctgaactgcagctgcatgggtaattatcttaagaacttttggcaaaatatggatgttggtgtgttactctcttctccctacaactctgaactaatctgtgtttggcaccttgatttgccatcataaatggccaccatttactcctcactgaaatattcttcttctttgaggttataatgtacttggaaaagttaatacttatagaaaataatgatctttattaccaactttattaaaacaggcttggaacatttttctccatagaagaatagtaataagacattctacatttcctggacatggccagtttaaaatattttgccccattacccttgtagatacacatgtatttgtcagtttatgtgcctcagttttgtcttaggcactgagggacagaaagagaaataaggaataccttggtattttcctttgcaagcaatcacagcagaatgctagaaaacataaaatatactcttataaattgtatgtgtgttgaaaccaaagtgtgaagaaattgtcaggtatttggaggaggaaaataatttgtaaaataacctttttaagaatttggattttgtacttatttaaggtgctaaatatgtgttaaaatatcccctcttgaatcagctccaggcttaaaagggcagagtggtttggattcttgtccagggtctggaaagagctcatcttgccgagagggaaataaatgtgagctttgaggcggtctaactacccagcttttagtatttatgttccccaaaatgtaaaaactgtaagttattcttgaaaatgtagtccagacatttctttgatcctggattttactgcagtttcatcatgggtttgttgaatgtgcagtccatttattgccctgtcttgcttaaatattcttgttgagaacagctggaggctttgactgggttcctagttctgttttctgggaaggcaacgtggattctgttttgtagacattaatgagctttaaatgggaattggggatgatgtatgttcgttgggcatgctgagaagcggcctcctgtggttctgggcccaaggtgtgacatacatttcccactaattgcttctctcaagaagcaagagattggctgttcctcttgaggaaaaaccttaataaaccttcccattttaaaaaaaaaaaaaaaaaaaaaaaaaaaaaaaaaaaaaaaaaaaaaaaataaaaaaaaaaattaaaaatatattatataaaattttaaanaaaatatatattaaaaaaaaaagggggggccccggtcccaattttcccctttataggaagtcgtttttacaattaaatgggccctattttt

SEQ ID NO: 407358 - DNA, 778 bp, Homo sapiens
ccaaagtgtgaagaaattgtcaggtatttggaggaggaaaataatttgtaaaataacctttttaagaatttggattttgtacttatttaaggtgctaaatatgtgttaaaatatcccctcttgaatcagctccaggcttaaaagggcagagtggtttggattcttgtccagggtctggaaagagctcatcttgccgagagggaaataaatgtgagctttgaggcggtctaactacccagcttttagtatttatgttccccaaaatgtaaaaactgtaagttattcttgaaaatgtagtccagacatttctttgatcctggattttactgcagtttcatcatgggtttgttgaatgtgcagtccatttattgccctgtcttgcttaaatattcttgttgagaacagctggaggctttgactgggttcctagttctgttttctgggaaggcaacgtggattctgttttgtagacattaatgagctttaaatgggaattggggatgatgtatgttcgttgggcatgctgagaagcggcctcctgtggttctgggcccaaggtgtgacatacatttcccactaattgcttctctcaagaagcaagagattggctgttcctcttgaggaaaaaccttaataaaccttcccattttaaacagtggtgtgactcttattttgagctgttgttttcaatgaatttttttaaagcttaccatgttcaaatttttgtgctgaatgttgtaggacatgcaaatcagaacaggacatgatccttaggggc

SEQ ID NO: 407359 - DNA, 851 bp, Homo sapiens
aattttaaacaaaatatgtatatactgttatgcataaagaaccttaggtgttcattcgtttgcttctattgatactacattaaatttacttataatcataggttaatagtttaatgaaagcataaaaatttagtatgcctatgtttttctctttctttccagacggattccatttctaggtatgttttatttattttttaactgacatttttttcttatttttatctttgttaaaaatgtgttgctaggaatttatggattttgtaagtttatagaattatttgataataaaaaacaaattttgatggccttatcattgttactagctttctttgttaaaggctttacttcaagatcactagtcagagcaagtaagatttttccccaaatctctacaacaaaggtattccaaagtttcttaagttagttcaactatctcattattaacatcagggactgataaaacccacacttggccagaaatgtatttgattaagtattcagaatcttctcttgtagccctgctttagacaaaagagaaccagtgaagacacttttaaaaaagtgtcatctagctcaacccttaatcctagcacttggggaggctgaggcaggagcatcacttgagtccaggagttgaagaccagcatggacaacatcaagactccatctctaccaaaaaaaaaaaaaatttcttaattatccaggcataactgtatgctcctctatttctagctgctggggaggctgagtcagaaggatcacttgagctcccaggagctcaaggttatagtgagctatggttgtgccactgcactcctcactggatacagtgagaccctgtgtcttta

SEQ ID NO: 407360 - DNA, 4220 bp, Homo sapiens
gcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaaccaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggatatatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaatatttgtgca

SEQ ID NO: 407361 - DNA, 1026 bp, Homo sapiens
gcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaagacccagcaggactcttggctagatgcccgataaaagttaattggaagttcttggatttctgattgatgtctctcctcagacactgatgtgtgaacagattgcctacaatgtaaaatagaatttggatcatccaattttagctgaccactgaccacatataatttttgaactaaaaattataactcttgaaggaattctaggaacctaggagcatttccaagggacaaaaataatgagtggttttgtttcactgagaatgagggataggacctcgtgcttctagactgctgagctcatttgcatgttcagccacattcttcattggctgaccaactgacataaacagaagaaggctgatctattaccttgacatataa

SEQ ID NO: 407362 - DNA, 3925 bp, Homo sapiens
gcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaagggtgttttgcaatatggatgtcaatgggggaggttggactgtaatacaacatcgtgaagatggaagtctagatttccaaagaggctggaaggaatataaaatggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaaccaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggatatatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaatatttgtgca

SEQ ID NO: 407363 - DNA, 2205 bp, Homo sapiens
gcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggtaagtcatgctacagtgtagtgttcgactaccttttacctagccacttaataattgtagtgggaaaatatgaaaaaaagaaatgaaaatcatccttcaaaatgaaaattcttttttttttggtctagacctattacaaagaggtacaaaaaagcctgtaaagactttttcaaagatttaaatttcagttttcgtaggttgactatctttgatattggcttaaattttagggaatggtgaatgaagtcaagcatactgttgttctgtggttatcatgcagttgcagtgaattcatatatataaaactgataagtttcatactcaaactcattggcttaaataatctctttattctaaaaaaagattttctggttctactttttttgatgacctttcttgaattagcatttttcaaatgatcttgaagatgacaaaagtaaaatttttttatgtttgaatgatttacataaaagagaagatgaggcatgatttagagggttttcttggtaaatctaaaaagcaaaaataaattgtaataatggcatcaatatacataatacatgattgcagatgtaaaaatagataaactatacacttaatgatacatgtttccaattatcctttttcaatgagaagctcgtctactaggga

SEQ ID NO: 407364 - DNA, 2201 bp, Homo sapiens
gcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacaga

SEQ ID NO: 407365 - DNA, 3989 bp, Homo sapiens
gcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaaccaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggatatatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaatatttgtgca

SEQ ID NO: 407366 - DNA, 2673 bp, Homo sapiens
  misc_feature (782)..(782): n is a, c, g, or t
  misc_feature (1081)..(1081): n is a, c, g, or t
  misc_feature (1182)..(1182): n is a, c, g, or t
  misc_feature (1247)..(1247): n is a, c, g, or t
  misc_feature (1864)..(1865): n is a, c, g, or t
  misc_feature (1872)..(1872): n is a, c, g, or t
  misc_feature (1881)..(1881): n is a, c, g, or t
  misc_feature (1890)..(1890): n is a, c, g, or t
  misc_feature (1892)..(1892): n is a, c, g, or t
  misc_feature (1910)..(1910): n is a, c, g, or t
  misc_feature (1916)..(1917): n is a, c, g, or t
  misc_feature (1919)..(1919): n is a, c, g, or t
  misc_feature (1924)..(1925): n is a, c, g, or t
  misc_feature (1931)..(1931): n is a, c, g, or t
  misc_feature (1935)..(1935): n is a, c, g, or t
caggattgttttggcttctccctttcattttcatatgaattttaggatcagtttgtcaatttctgtaaaaaagccagctgggactttgcaagggattgtgttgaatttgtagattaatttgggaactattgtcatgtatattagtttcctactgctgctgtaacaaactcacagactgggtgtttaaaacaatacaagtttattatcttacagttctgggagtcagaataccaaaatgtgccttatatggctaaaataaaggtgtcagcagggctgtacttctggaggctgcaggggagtattcattttcttgtctttgaagcttctagaggcagcctgtatttcctgactcacagccccttcctccatctgcaaagtatatcattccaacctctgctttctttgtcgcatttccttcttctgcctttgacctttttgtctccttcataaggattcttgtgattacattaggtccatgtagataacccaagataatcttcataactttatcacatctaccagttccttttgccaggtaaggtaacatattcacaggttctggagattagacatagaattcttttggggaccattattctatttactgcattatcttaacaatattaaatcttccaatccatgcacatgggatgtcttttcatttaagtctcctttaatttatttcaatgatgttttgcagttttcaatgtacaagtcttacatttaatttgttaaatttactccaaaatattttattattttttgtgcttttgtaaatgganttgttttcttaattttatttttggattgctcattgctagtgtagagaaatacaaatgattttttgcatattgatctcaagaaatcttgttaaactcggagtttctttttggaatgatgaaaatattctgaattagatcgtagtgatggttatgcaacagtgaatatcctaaaaaatcacagaattgtatactttaaaggggcgaattttatggtctatgaattgtatctcaataaagtcattattaacaaacaaactataccatttgggaatggccatcaaaaattaaaatgtgaattnttctctcaaaatgaggttggaggggtgtgagaggaaagttggggaccagaagtgcccatgttttgatacattctcttattacttccagatgggaactctanaagttgcatatcctgattttgtatgtttggtggaagaacttctcttcatagctcttttgttcctngacacaccaaactcctgaatggcagagggctttggcttttgttctctacctgagtcattctctccccagatccttacatggcaggctccttcttgccattcaggtcttggttatgagaggacttccctgccaatcaaatctaatctaaagcagcttctccaatgcaatcgttctttatcataccactgtgttttttctgtcaggaactggaatgattttctttattaattgcttacttgcttgtatatttcttccctgtaaaatgtaagctctatcacagcagggatctatactgtttcattcactataatatatctccaacttctaggatatagctggcacatagaagatgatcactaaatttttattgaatgaatgacgcatatcattaaggagaaaagttggccaggcgcagtggctcacgcctgtaatcccagcacttttggaggccaaggtgggtggatcacctgaggtcaggaattcaagaccagtctgaccaatatggtgaaaccctgtctctactaaaaatacaaaaattagccagtcatggtggcacgtgcctgtagtcccagctacgggggaggctgcgacaggagaattgcttgaacccaggaggnngaggttncagtgagcngagatcgtncnactgcactccagcctggntgacanngngagannctgtcncaanaaataataataatttttcataaaaagaaaataagttctcaccgagaccaatacaatgaaacactatccatccactctcagagtgaccaggcaaattacatgatctctcagcatctcccttttatcatctttaaaatggtgataataatattatcaacctcctagggttgttgaaaatttaaaagactaaattcctggaaagaatttaaaagactgtcctacacagtaagtctgcaataaacatcagtcagtagtaatagaggtagtactggtagcagcagcagtagcagctgcagcagcaaagctctatgctgtaactatggccaattctgttctaagtcaaaaagagtcaggcaaattgcacacaacatcttcacatggcactgttactgtgctcgaaagatttgatctctcatacttaacagtctgaaggtaacctgtttctttgatttgaagttggttgaaaagcatagatggtattgatgacatgttacatacttatgggtcagcccaagaaagaccagggaacacctaatttccctaaataagaagaaatttatgaggggatctccaagcctagtaacagtgccagggagcatgcattctgagggccaaagtctgcattttgaaggccaagatctgtgtgctaagcgccctgggaacagcttaggctgccaaaaatgctgcgttagccagaagccttgctgtccagctgagccagctcttggctaaaccacca

SEQ ID NO: 407367 - DNA, 1759 bp, Homo sapiens
  misc_feature (782)..(782): n is a, c, g, or t
  misc_feature (1081)..(1081): n is a, c, g, or t
  misc_feature (1182)..(1182): n is a, c, g, or t
  misc_feature (1247)..(1247): n is a, c, g, or t
caggattgttttggcttctccctttcattttcatatgaattttaggatcagtttgtcaatttctgtaaaaaagccagctgggactttgcaagggattgtgttgaatttgtagattaatttgggaactattgtcatgtatattagtttcctactgctgctgtaacaaactcacagactgggtgtttaaaacaatacaagtttattatcttacagttctgggagtcagaataccaaaatgtgccttatatggctaaaataaaggtgtcagcagggctgtacttctggaggctgcaggggagtattcattttcttgtctttgaagcttctagaggcagcctgtatttcctgactcacagccccttcctccatctgcaaagtatatcattccaacctctgctttctttgtcgcatttccttcttctgcctttgacctttttgtctccttcataaggattcttgtgattacattaggtccatgtagataacccaagataatcttcataactttatcacatctaccagttccttttgccaggtaaggtaacatattcacaggttctggagattagacatagaattcttttggggaccattattctatttactgcattatcttaacaatattaaatcttccaatccatgcacatgggatgtcttttcatttaagtctcctttaatttatttcaatgatgttttgcagttttcaatgtacaagtcttacatttaatttgttaaatttactccaaaatattttattattttttgtgcttttgtaaatgganttgttttcttaattttatttttggattgctcattgctagtgtagagaaatacaaatgattttttgcatattgatctcaagaaatcttgttaaactcggagtttctttttggaatgatgaaaatattctgaattagatcgtagtgatggttatgcaacagtgaatatcctaaaaaatcacagaattgtatactttaaaggggcgaattttatggtctatgaattgtatctcaataaagtcattattaacaaacaaactataccatttgggaatggccatcaaaaattaaaatgtgaattnttctctcaaaatgaggttggaggggtgtgagaggaaagttggggaccagaagtgcccatgttttgatacattctcttattacttccagatgggaactctanaagttgcatatcctgattttgtatgtttggtggaagaacttctcttcatagctcttttgttcctngacacaccaaactcctgaatggcagagggctttggcttttgttctctacctgagtcattctctccccagatccttacatggcaggctccttcttgccattcaggtcttggttatgagaggacttccctgccaatcaaatctaatctaaagcagcttctccaatgcaatcgttctttatcataccactgtgttttttctgtcaggaactggaatgattttctttattaattgcttacttgcttgtatatttcttccctgtaaaatgtaagctctatcacagcagggatctatactgtttcattcactataatatatctccaacttctaggatatagctggcacatagaagatgatcactaaatttttattgaatgaatgacgcatatcattaaggagaaaagttggccaggcgcagtggctcacgcctgtaatcccagcacttttggaggccaagcattattgtggtaatagataacgaatacaagaatcaaagggaaggatgagtattctgg

SEQ ID NO: 407368 - DNA, 958 bp, Homo sapiens
aaatgaagtttaataatatattttatttaacccaatgtacactattaaaaaataacccaatattttcaacatttaatcaatgtaaaaatggagatattacatgtgtgtatatataatacataaaattaataatataggaataatgaataatatatattatatgtaaaatatgtattttttataccaagtttttaaaatctgaggaatatttcacacttacagcacatgttaatttggactaatcacacatttcaagtgctcagtagacatagtggatagtgaagacctaaagtacctttttttctttgtttttaattgtagacagagtcttatttcagaggtgggtactatgaaatcacagactgttggcagatgtttgagtacaatgactttaatttcactcttgactaatgctaatgtcattttcattcccaggaagcctgtcttgctacagtttggtggagggtcaagaaagatgattcagaagtatgtcttttaagagtcttggtgacacgcacagagcccagtgactttagtctgggtgtggtgagctgacctcagagtctattgtgtgagtgtttttcacttttgagtttgttttacttttgtggtctccccagccttatttgtgagtgcaatctaaggaaagtatatttgttttgcaagcacactatggtttgctcagatttttaaatgacatatgtaggattacaccctctttattctgtcagtgtttccattaaaaattcaaactttctgggatttattacacagccataacaaattgctccaggcagaaacttggcaaaccctctttagtgtgggagaaaaattcttttcatcattttagaaaagataaaaataaataaatgtttaccaactcaacttactcatgtgattttgtgatagggaagacattcaattaaaatacacattatatcttcacatttgtttgtcg

SEQ ID NO: 407369 - DNA, 744 bp, Homo sapiens
tcttcttcaccccaaccccacccacatgctggaagactacttctgaagagggaagctgctggtgcatcgggcgcccagcagagggagctgaggagggccgaggaggacgccgacaccagctgacgccccgtgcaggagtgtaatgtacttgtgctctctgaggcctggagccagaagccagatgtttttctgggatgacgaggaggcggttctagaactctgaagcctgtcttgctacagtttggtggagggtcaagaaagatgattcagaagtatgtcttttaagagtcttggtgacacgcacagagcccagtgactttagtctgggtgtggtgagctgacctcagagtctattgtgtgagtgtttttcacttttgagtttgttttacttttgtggtctccccagccttatttgtgagtgcaatctaaggaaagtatatttgttttgcaagcacactatggtttgctcagatttttaaatgacatatgtaggattacaccctctttattctgtcagtgtttccattaaaaattcaaactttctgggatttattacacagccataacaaattgctccaggcagaaacttggcaaaccctctttagtgtgggagaaaaattcttttcatcattttagaaaagataaaaataaataaatgtttaccaactcaacttactcatgtgattttgtgatagggaagacattcaattaaaatacacattatatcttcacatttgtttgtcg

SEQ ID NO: 407370 - DNA, 302 bp, Homo sapiens
cttcacaggaggccctgttttgagaggtgcatgaacatgtggctcacgttcaacaacaaacactcaggagaggggacagaatgttcaggacacaccgaatttccaagacgtacagatctctccaagcatcccaaaaggcgtatgttcctggtggggccgagggcctgctcttggagacagatggcgagcagcggtcagcagctactgagagctcaacttcccctctagagacaggctctgccgctcaagtccacctgggtcttggctctctgaatcctgtccgagggtggcgaacttgaggc

SEQ ID NO: 407371 - DNA, 287 bp, Homo sapiens
agaacatacaaatcccttgacttctaatgtagttattttacaacatcctttattagggaatatgtatttaagcagcttgattcatcagcccaaaagtcataaattgtacccattccaacacaaatccctgattgtggtgtcagtgaaggtagagttttctttgtctttttgtttcctaatgcatcctcaggactaaacatttcatagcatatttctggacttctgccttgagcttcctatttgaaatttgctctgtcattctttctctgtgttgactctgtagggtt

SEQ ID NO: 407372 - DNA, 395 bp, Homo sapiens
cgcaggcaaatgtgtgtgtgtgtgggggggggaatagctagccttaaacaaaaatgtgcatgtgtaaatatgttgtgtatgtatgtatttgcaggaatactatcagaataaagtttacagaggttggggttggcatatgatatgaagttttatataagaaacctcattactctaagttataaaatgcagaacttagtatttaaaatactgaataagccttcaataagattggagaaaaaagttatatggttttctccttgctttagtctgcgagtatgtgtttcttttagtctcatatttttcaaaatcattacccagtttgtagtcaattaagtgtttcctggttaaatgaagttgttttataattgtatatgtttttgcatctcctttaaacc

SEQ ID NO: 407373 - DNA, 382 bp, Homo sapiens
tctggcttcaagcagtcctctgccttggtatcccaaagtgttggaattacagacctgagcggccacgcctgggcgtgaaagtcttaagaaatgaaaaattatgagacataaagaataaatgaaaggaagttatgtttcaaacatggtagtaaggatggagtagagggaaagggtcaagttagatgtgaagagacgagagtaagaagcttgaaaagagcacatacgtattgttacatgtgctgacaacagcaatcatacccagtgcttattaactgctgtgggcaaggcatgcactgctgtcttgacatttattttgtcacctaatttcacagtaatcttatgaaacagaggcccttgttttctgcagctcacgggaggaagg

SEQ ID NO: 407374 - DNA, 760 bp, Homo sapiens
gctggatgacagatcgtcagtgcagaatgagacacgaggtgcctgtgtttattcatgcaggaggagtgtttgcagaagtgccgggaacaagaggtggtggagcaaagcatctctttcctggtttccttctgctctgaactcaagtagtacccaccccctattcttcccctcttttgagtctgtttcactgagggcacggctggtaggagtaacgttgtccagcattaaaacagagcatcagtaatgtctaggaaaatgttaactttaacaacaccactaatcagtttagagaatatttgagcgtgtagcacttgctgatcattcattcagaaaatgaattgcctgccataaactaataagcatgatttggtttatgttttgatttaattatctctgagtagatgctgcttgaagtaatgactgtaatcacttttgccaagcataccccccgtttataatttaagaaaaaaaatttttttttttttgagatggggccttgttatgttggccaggctggtcttgaactcctggcctcaagcagtcctccccacctggtgtctcaaagcactgggattacaggcatgggccaacatactgaacataatgattcaaacatagaaaaaaaagtctcctggtagttcagttcccccatgccccaggagtttagtacaggggtgtccagtcttttggcttccctgggccacattcccttgggccacacataaaatacactaacactaacaatagttgatgagctaaa

SEQ ID NO: 407375 - DNA, 336 bp, Homo sapiens
gaggggaaactgaggcttggaaaaggcacatggtcccatgtagcgtcactgtggctcttcggactcttccaggtccctctgcctgtcctgggcctgccattgttccacctccaggtctgcccactgcctgcacctctcctccccgtctcaccttgccctgcactgcagctgccacgacctccagcagccctttagaccaacgtcctaaagcgataatgccatgatgttcctggctttttcaaaacccttttcctagagtgtgttaaccagaatggcagtcccacgaggatctctgtgatgaaagggcttcatggtcaaatagtttgggaaacgtgg

SEQ ID NO: 407376 - DNA, 2777 bp, Homo sapiens
  misc_feature (1315)..(1315): n is a, c, g, or t
  misc_feature (1458)..(1458): n is a, c, g, or t
  misc_feature (1516)..(1516): n is a, c, g, or t
tttatgcatcatggtttgatatatgcttgaaatatttactaaattagatattgctgcatgtggtccatcccacatataaatggaaaagagaaacttaacatagttcataaattaaaatatttggtttcagctgtattcatattgaaaccataaaagaatcagaattactgtgggtttatgattgtcaggttaccaccatcactacaaattttctgataacaacatattagtattctgataaggtttgtggcttctttgcaaggatatttgaatactactcaacacactacataatggttaactattgttgtctttattttaaggaaggcatgaatattgttagatttgcccctaagtaattgagtgatcatttttatatacaagaaaatcagagtagaatgcaaaatttggaacaggaactcaataatacttataaataagttgattcaaagaaatgtttcaatttcttgacattgaattcatgatgttttgcttttaacatgtgatttttaaaaaatactgttatgtgtacaggggaaggctaacctgagactttcccttcatgcgtattcttcctgtgcactgcaaaaggaaactgtgtgactgctttccttcctgactggccatcacatagggttactggcagatgccaggaatccaaggactaaaggaataaagggtgtgtgttatagtacctgcgctaagagatactgtcaaactcagaggcacccctcctcctccatgtcttaaccctagaattgttttagaacttcttatggataagtgtttggattaagggagatctgggaaatgggatttgaattttaagcaagtgagccctggggatggctagctgcccaaagtctctaggaccccaaagagattatgagagagaacgttgagaggtctggaatgaattatacatactcttataatgaactttctccaacttgtccttgagcagctgtctccatcccatccctcaagtgctttggaacccacatcttataacaatggaaagatagataaccttttattttaatgtgtttatttttattttaatgtatttaagtagtttaaacactttcagcgaaaacgcattgtatttctcactccattcctcaatccagatgtataactaaagtaccatagtgctgtccattattagcccattttgtgttttaacctatacagtttgaggaacaagaaacctacctgacatcaagattatactatcagtgaagccagagaagctatacttattcattgtagacattcttatctttttaaattttttatattaaaaaaaaaaaanaggctgggcattgtgtatcacgcctgtaatcccagtgctttgggaggccgaggtgggtggatcacgaacgaggtcaggagttcaagaccagcctggccaagatggtgaaaccccatctctactaaaaatacaaaaattagccnggtgcagtggcaggtgcctgtaatcccagctactcggagggctgacgcaggagaatcncttgaactcaggggtcggaggttgcagtgagccaagatcacgccactgcactctagcctgagtgacagagtgagactctgtctcaaaagaaaaaaaggaaaaataatggggtctcactatgttgcccaggctggtctcaaactcctggactcaagcaatccttgcatctcgtcctcccaaagtgctgagattacaggcatgggccattgtacccggctatcttatcttctttatatagatatctaataagatgtaaaatactgacctgcattatctccatgttaacatttacacttcaaaatctgtaaacggacccacgttcatacgcgtgaacagaaatctttcagcaacaaaagagaaaattgtatttctcgatagaaaggaagtggtcagatcatgccagccaaacaaatctgtcaggctttgaaatatagaaccgttaggtaagatactgagataaaggataaagtaagatcagcctaaatgtttcagtctagttaagttgatttgtatattacttagaaatttcattttcagggaaatagttttcagatttaaataactgtaaagagctgagttattctttgacttggatttaaaaaaaaagaaaaaaagtgtcctgaagtcatttcctgccagtttgtccccccaactttttttcctgctcttcctgtaactggttcttgttacggcaatgtagctgtatatttaaatcctaagagactcgcttattgtgagtaggcagggtcagtagtctgctgaaacaagcacaggaaacttgaaacacctaggggctattttaaaaatcccttgccactgacattttagttagaattctaaagagagaatgggctgtttggatactgagctccagtacaaaagagctggggtttttacaccgacttgcaaaccactaaaatcatttgacctggtgttgtgtcacttgggtattctgaagcatcagatgaaaactaatatccaccctgcaaggttggcaggcaacaattgtacctgtgaagtgagcatctatcaaagaattggggaaggaaggccgggcgcagtggctcacgcctgtaatcccagccagtactttgggaggccaaggcgggcagatcacgacgtcatgagatcgagaccgtcctggctaacacagtgaaaccacgtctctactaaaaatccaaaaattagctgggcatggtggcgggagcctgaaattccagctactcaagagctgaggcaacagactcggttggggatccta

SEQ ID NO: 407377 - DNA, 617 bp, Homo sapiens
gtggcctccaaaataaacaacaggactgctcagtagtcagagtgaattttgggtggggtttgaaagagttccagctttcctctgctaatggtgacataaaatgttcatttcatacccatgcatatacactgatgtatacatgtagttgaggaggcagtggcagaagccagaaggctttctctgccatgagctcctcctaggagccctgggttgcagagggtgaggactgctaggaaagtccgtcagttaaggccgaagggacattagctttgccttaaaccacattggctgtgcttgcctttgtgtcttcacctgatttaatgggttttagctcacactctccgaatctatttacctccaagtcagttaaggcagactgtactgttgacaaagctaagcagaacagaatttccccatggcttctagcttcaaggaatcccagctatttatccatcaccaagaaatgaagccccatgggtggctgacggttcatttactccagcccagggtgttggatttcaattagtgcattcgcttttccctctaggcagagctcaccctttaaagtcgctccttggcctgctaactgtcttaagatgcactttcccatctcaaca

SEQ ID NO: 407378 - DNA, 269 bp, Homo sapiens
tttataggtaggtatccaaatggcctagctatctggatagagaccagcagaagaggtaggaaccaggcacagactatagagtgccttgggtataccagtgtgcacgcatgtgcgcgcgcgcgtgtgtgtgtgtgtgtgcgcggagaaagagagagaaatttagctcatatatagtgagtaatttttatatatcaaattgtgttaaaggtacaaacactgtgactcggaatctaaagatcccttctctctctgttggtgctttcttattc

SEQ ID NO: 407379 - DNA, 325 bp, Homo sapiens
ggtttcacactcactagctcacgtttgtgtgtaacaaactaatggctgtgtttgtaggtcctttccaagggcctaggggtctactgtgccaagtaccaggagggtgaacaacaccatgggataaacgtgggaaatcttctaagaacaaccatctcacttgaaaaatggagggaaaaaaaactccacaatttttatattaaaacaattaagaattacatttcacaatacaatggaaacctagcattatttgtttatttgtttatttttcttgagacaaggtctcactctgtcacccaggctggagtgcagtggtgcaatctcagct

SEQ ID NO: 407380 - DNA, 888 bp, Homo sapiens
ttcaggaaatctcgaattcagacgtaagcctaaccctgcattagaaaaaatgttcaccgggttagagcagtggtattcctggggatctttatgctaaggatctgagttacatactcctgggaggtaggagagaaggcctcatttcattccctctggcgtgctgtcaatcaggcaattattgctaatattgactttccctttgtaggtatgttcagaactgttaagtcacaactggagagtaagttcccacttgtttataattcccttttagtctgagcagaggacagtctgttcacggctaggaatcaagttgaaagttggaattctgtagccctggccgaggcaggttttgctgtaagaaatcttttcagtttagcaccaacatcttcctaggtttcctgtctagacagtgcaaagcagtggaacatgcgagaaacgaaaaagccatggaaagggagggagacatgcttgcaaataggcctcaaaaatggaggtctcccactttattggtatcagaattacttggagagttttttagaagggtagatccccaggccccgcccccacctccaaagtcctgagcagctggaggtacacagtcatttggagggggaggaaaactgatggattctacctgaggcaaaaagatgagggaaaggaacaaagaaaaagggctgaaaaaaggtctataaacacatgggtggaaatgagcaaaagcacagaagaaacataaaataacaaacgtggctcatggagctgagtggaacagcagcagccaggcatatgacctcggtgagaaagcaccatgttgcacgaggcttcataaattctggttctccctggagtctctgcttctagaacacattagccacacaaaatcctcaaaaa

SEQ ID NO: 407381 - DNA, 1425 bp, Homo sapiens
gcacgaatatgatcgctgggaagagataggtccgcgatgcaaggggtgattggtgcacagatcgacggcgtagtgtggcgaaacgctactggagtgtgggtggtgggtgccggatggatggacagtaccgcgtgggaatgttgcgcgagcaagtaagtatgagagactaatgatgagaagcgtaaggagatgtgggagagaagaggaggcagtgagcgtcagtgattgagaagtgctgcctataggggacgtctacggtggggcagaagttcatgtgaacggagcgtagatttataggttctctgttgaggatgttcttcgaagcgtcgccgccgctggtttttctgttgagtcgtgtgttgtggaagatgattctgttttttgttgtgtggagggatttttggtgttgggctaatgggcgttctgaggtagcaggagagctccagtgagataccaagaatgttaatgaaagcaattcgtggcaaacagtgtgggcttgtctgcaccggaggtcataatggcactggtctgcgtgtgtgtgccacgtgaagtctccatgagcacacgtggtggttaaaatgtatggctttgattcaggagcgatttgcagcaggtggtcaacccaagtgtaggtttataggaccttgtttgtcagccgtttgttgcggttgattcctttacctgcatcttgtgttgcctcaggtagaatccatcagtttgtcctcacacctcccaatatgactggtgtaccagccagactgcttcaggactttggagatggggggcggggacctggggatggtacccttctaaaactctccaagtaattctgataccaataaagtgggagacctccatttgtgaggcctatttgccaagcatgtctccctcccgtgtccatggctttttcgtttcatcgcatcttcctaggtttcctgtctagacagtgcaaagcagtggaacatgcgagaaacgaaaaagccatggaaagggagggagacatgcttgcaaataggcctcaaaaatggaggtctcccactttattggtatcagaattacttggagagttttttagaagggtagatccccaggccccgcccccacctccaaagtcctgagcagctggaggtacacagtcatttggagggggaggaaaactgatggattctacctgaggcaaaaagatgagggaaaggaacaaagaaaaagggctgaaaaaaggtctataaacacatgggtggaaatgagcaaaagcacagaagaaacataaaataacaaacgtggctcatggagctgagtggaacagcagcagccaggcatatgacctcggtgagaaagcaccatgttgcacgaggcttcataaattctggttctccctggagtctctgcttctagaacacattagccacacaaaatcctcaaaaa

SEQ ID NO: 407382 - DNA, 393 bp, Homo sapiens
gtgataagtaaagaccagaaggaagtgagggagacagccatatagacatttgggaaatttggcctaggcagccaaaatagcagatgccgaagcgcggaggcagggagtaagctcggccagcctctgccttgagctcagcctcatgcccaagctcccctcgccatacctttggaaacttttgctgtttagttctggggggtcatgggcttggtccccagaggcctgggcccaccctgtcaacccaggcctcagtgtgccaaccaacatcagaaatggcccactggaggcagcctggtcctgtggggcacaaccgtccaactcagggtgggcagtgcgggaagacagcctggggcagaggctcagcccaggccaggggccgggaacagggccctg

SEQ ID NO: 407383 - DNA, 460 bp, Homo sapiens
tctgaggctctgcattgttggaggaagggtcagaggggctggagaggaagaaacaatgcaaatatgaggcagcagaagggaaatcgaggtactgggggcttccagcctcatgctgcttgctctctcctgaatccatcgttggtctttctgtcctaatccgaccactccatcgccagcctccattcctctgaatgttgatagaagagctccggactctttccagctttccagacttttccactcacacagactcaagggtcctcccaactgtcttgtgaaaagaggccatcccattccacaggaggggaaactgaggcttggaaaaggcacatggtcccatgtagcgtcactgtggctcttcggactcttccaggtccctctgcctgtcctgggcctgccattgttccacctccaggtctgcccactgcctgcacctctcctccccgtctcaccttgccct

SEQ ID NO: 407384 - DNA, 432 bp, Homo sapiens
tgagatatttccttgacttaggttgtaatatccatctcttttaaaaaaagaattttacattttccttttgaataagatttatttttaaactgctttgttttagccatggggatcatcagaaaagatagagtacacatttctcctttaacagttatctttagccaggcgtggtgcttcacgcctgtaatcccagtgctttgggtggccaaggccagaggattacttgaggccaggagtttgagacaagcatgggcaacagtgagacctcctctctacaaattttttttagaaaattggctggagatggaggacgcatttgtagtcctaactactcaggaggctgatgaggaggattccttgagcctaggagttcaaggttacagtgagctatgatcatgccagtgcactccagcctagatgacacagcaagac

SEQ ID NO: 407385 - DNA, 172 bp, Homo sapiens
atgaggggacatgggatttaagtttgttacactacagctctcagccagcacactgccatgatctggctcatggccacaactctgccctcgtctctagtgtcctgcatagcttagtttctcccattttcagagagcagtctcaggaagtagcacactgatcactcacaccaag

SEQ ID NO: 407386 - DNA, 293 bp, Homo sapiens
cctgaagcagatttagacttcattttctgacacctctcgtcctttcatgcgaagggaaaaaattactcatttagccttcgtgttgtcttgtatgagctcttgtattgtcaaggacaagagaaatgtgcagttgcttttaaggttagatattccttctcattgctgggacctgagattttttaaatggattctcgttcccaaaaggtaatgttttctggaaagcagttccaaaacataaggatgctcatggaagcatattcttttgaaggaacctccgctggactgcccctaca

SEQ ID NO: 407387 - DNA, 395 bp, Homo sapiens
aatttaacctgtgtttcataattcagtaagccggatagtacccacggatcagtagttctgatggccccagcctgtcacgtgtcctctggggatcctttgattgttatcctcccaaagtgctcattcccagaaaatggattaatcaggccagtgaaagcctcaggctccataataaagtcccatgggcctacttatcttcctcttctggggtgcatgcaggttggccaccttagccatgccctagaagaggaaggaagccaaacagaagtgttcttcccaaccctgggtcccagatgcccactccttactgcgctctgggcctctctccttcctgtctggctagtccattgttctctgccttctagaaagagggccctcccatcaatagctgaagt

SEQ ID NO: 407388 - DNA, 509 bp, Homo sapiens
cagaatggtaaaattcatgattggtttagagcaaggccacagtatcaggcttacatccatattatatgacagagaaattaacttttattatattttatccactttaatttggggcagttttactattttactcacaaccaaatttaatcttaaacgctacaactagattgtcacatgtaaaaagtaataaccatcattatatcttttatgttctgtaattccaaagcacggatctgtagagaacagagtgtctatcccatgcatgttgtcatgtacttatcccacaccctattgaaatcacagtacccataagggagactttttttttcttcaagaatatgtatttctgccacatctatgattctccagaatgagatgacagaaaatgctaaactattgttaaatgactatatgtagttccacttctggatggtagatgggggggctctgcaaactcattttctaataaaactggcaaaaaaaaatgtataaaaaccttgccatttgag

SEQ ID NO: 407389 - DNA, 302 bp, Homo sapiens
gcacacctgtagtcccaggtactctggagattgaggtgggaggattgcttgagcccagtagtttgaggctgcagtgaggtgtgatcatgcctctgcacttcagcttgggaaacagagtaagaccatgtctcaaaaagaacaaaaaaagactttcttatttgtctgatatacctgtatattaccttatgaaagaagcagaaatccccattttgcagataagaaaaccaaagcccagagaaatgaagcggcttgtccccaagattgcttagcgaatgatggagctgggaaaagcccaatcttcc

SEQ ID NO: 407390 - DNA, 1989 bp, Homo sapiens
cggccgctgcccgtcgcccgggactccccgccctccctcgcgaccccgcgccggggcgggcggcgcttgcggcgggcagggggcgggcaggggagagggggctcgtccgggggtagccgcctcctctgcagcctgccggcgcctcgaagcccggacctgcctccgcctcttcctccagcggctccatcccgcctcccgtgcctcgtcctcccgccgcctccgccgccgcgcccccggtggctgcctcggcggaccggggagggggcccaccgcgtcgaccgcccgctcggctcggctcggcccggcccgggaggcgtgcatgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggtaacatctgtacagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactttatttttagaaagtatgttctatagtaaaataatgtttccacattatattatgttatatttcacttaaaatactattcatactatacattctaagactggtgcttctgcttttgaaggggaaaatgccaatttttactgtaataagtaatgtatcataattaaaaattatttatttgga

SEQ ID NO: 407391 - DNA, 4124 bp, Homo sapiens
cggccgctgcccgtcgcccgggactccccgccctccctcgcgaccccgcgccggggcgggcggcgcttgcggcgggcagggggcgggcaggggagagggggctcgtccgggggtagccgcctcctctgcagcctgccggcgcctcgaagcccggacctgcctccgcctcttcctccagcggctccatcccgcctcccgtgcctcgtcctcccgccgcctccgccgccgcgcccccggtggctgcctcggcggaccggggagggggcccaccgcgtcgaccgcccgctcggctcggctcggcccggcccgggaggcgtgcatgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggtaacatctgtacagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactttatttttagaaagtatgttctatagtaaaataatgtttccacattatattatgttatatttcacttaaaatactattcatactatacattctaagactggtgcttctgcttttgaaggggaaaatgccaatttttactgtaataagtaatgtatcataattaaaaattatttatttggacttcttctcctgacaattgtggcttaattcatgacttgtttttgaatgcaggcagtatttagggtagtttaaatgagtaaattcagcactggtaccttattattgagtaatttcccatgggtagcagtgtctcaagagtggtcaaaagctccactcttaggcttttttactactaaagattccacataatttaaatgggaaagaactataccctgacacataatttaaattatataaatgctagaaatatggttaatgtattttactttgcatttgtgtagtactttatagtttacaaagcatatttacaccaattattttatgtaatcctcataataacctggtataaacatgaagggtatggctttatttttatagataagaaaaatgaagccaagacagggtaaataacatgccaaatcacaaactagtaagagacatagttgaagcttaaattcaagttttctggccctgaactcatattcctttctaatatagcacagctgtcatctcattttggacactgaggcctttcagagctcagtagaatcctgggcaactacctatggttcaaaaaataaagaaatgccagaatacaaatatgaaagctctgctgtattttaaatgtttatgttttaagaatgaacacttttcaaatataaaactatataataattataatccagttttaagataatatcaagagtctagatgtgaggctttttgtgaaagagaagcctaaattcagcatctccccttccaccctcacccccaggtcccagcctcccactcagcagagtgcccaagggacataccttacatttagcatgtagaattccagattacaatcgccataatataaggaaggtgagctcctcaacaataactttgcaataattaaaactaccctaagtaactttggcttatatggcaaagtaactttggcagtaattgactgaaatgaacctttctaaactttacggtactaaagaaagcaaacttttaatttcctctgtaatttcaacagagatcagcaaataaatataaccaaagattgtccattactccccaaatagatgttatttgcccatttctatcactgtggaagctaaaacacttctactagggccaaaaagagaaaagaaaagaaaatttctactaatttcagacctctagagcaattcagtcctgttggaaatttagaacatgaagaaactttgaatgtcttgaccctttttaaagattttttaggcaataacagtaatagggaattcacttattgagaatgaaagtgaaggggatgatcctaatgtcttagaaagctagattactagtaaggcttccagacttctatcagttctattgattctacatcagacttccaagcagccaagcaggaatgtttttcctgttggaagccttagccatatattcttatgtcaaggttgcttctttgcaccttgctaaacctgatacgaatgcaggagttttaaattcttcaaaaactcagatttaacccagaaccagagtaaagtcacctctactatttacacatcataggctcaagattgtacagtgagtgatgctgtcatgaagaaaattcagatgaaaaaggcaagatacatgtgaataaggcaaaagccagaaaatagcccttattcatgatgctgttactgagaataatgaaaatcatatttcagaaaatattaccatgtaaatatgtacatatgtagtctagtaaaagcaggcaaacacatatctttctgataaaaacatcctccctttttattcctacttacttggggcccaggtcagtataatttagtcaacttgaaaatttcggtagtctctgtttgcatggcagaaattctgcacatgttttatctgattcctgtgataacttaaaaggctcttttatgttaaaagagaggtgaatcttctttgacagactttgtattttccacttctaactgggcctctcttttctcaggatctatcctagccaaatatctcagttacatttaccatacagtttcctttgtgaaagaacagtaggggaggaaataattctctgctgtgtattgtatttttcaaataaaaatttaaaaattcaattgaaaactgaattttgactt

SEQ ID NO: 407392 - DNA, 424 bp, Homo sapiens
tcttttctcttgtgttgctctttgaaagggacctttttgtgagatactgccataagctagggtaggtcattttaatgccctgtatcaagcattcacatgagtagacatcttcaaaagaatttcacatataggtggtaaatgtgactttgattagccttatgaatgcttgtcagtgtatgatgtatttttacacttttgttctttttaatatgattagaaagtagaagggttattatggtgaggaaatgagtaaggttgggaatgataattcactgtattatgtgtctgacatatccctattcctactgtttgtagaatatcaaagcacactaaggtccaggtgcagtggttcacgcctgtaatctcagcactttgggaggccgaggcaggtggatcacctgaggtcaggagttcgagaccagac

SEQ ID NO: 407393 - DNA, 478 bp, Homo sapiens
tcgcctgcccatgttcttgattaactgtcaaatcagtcaggctcaaacttttgaaaattttaacgccctctttttttctcccttctcatgtataaaatgagttctgcacgtttttttcttgaaattatctttttcttcttctccctagttcaagcttctaccatatcatgtgtggatagttgcaaaaccgacagagtgtccagtttttccctggcccaatccactttgtgtggatacttctcatactaatcttctttaaatgctattttcatcgatgcctccaaaaaccataatgagcccctgtttcttataaattatgtcccactcctctcttggcttagctctccaaaagccagcaccacccctgggagccagctttctaatccccaacacaaacctcctgcttcagtctatctggcttgctcttgggcccttgagttatccatgctggtgtctgcctctgaaactttgtattgtc

SEQ ID NO: 407394 - DNA, 783 bp, Homo sapiens
aagctgaggactggtcaggttgtttttatgtggtggatactactggcacgtgagatggaatcttgtttttcctatgggaatggtggtggttgattagacaagtaataggtctattaaaaaaatttcaggaggtatctacttagttgatttagctgacaacaaaagagctaacattagatttcacactgttttctattaaaaagcaaactttgctgattactttggaagaatccctgatttgggggtagcagagtaacttttaattggagaagctgggaaagcaaacccattttgtttcattatttgcattttataaagtgagctaatgcttgcactccattttttttaatcaaccctttcaatgtaattacaaaatgaaattcatggttgaaaaacaaaagagggcagatataactgagaggttttgtgctaaggcttatattgttacacatgtaaataatgaaaatattgttatatatcaccagatctttttaatgaatttggtcattgtgttcctttgcagtgcaagtgtcttgtgcttcgtaaagtgcccatttgtttcctccatttcaatccaaccccccctccccttccaacccaaaggaaagtgacaaagttctgttccatcagccttgctaatcccaagctaggcccacttacagtttacagtctcctgtggctcttgatcagttgtccaagcctccgtcgctcccacaaccatcttcccctggcaagtctgtgcgataaatcattcaaggtgtattgaaaatagtcactttgcta

SEQ ID NO: 407395 - DNA, 307 bp, Homo sapiens
gctcacttccttctttaaaaaaaaatgcccacagtaattccaaatccatatggccagaagtggaaaatatccacaaaataagcttagcagggacagtgttcagtgtctgctttgccatctattgactttcttcaatatatggtaatataagtaacctctaataaagttatcacagtctttattaccagccacataaattaatcaattaaaacattctcagaagaataattgcatttgccttgtagttcaaaataacttcattacacttttttcagaacatcgctttcctctaatattagtctttaga

SEQ ID NO: 407396 - DNA, 537 bp, Homo sapiens
agaaaggaggctgagagctgtgactgcctgcagggtttccagctgacccactccctgggtggggggactgggtctgggatgggtaccctcctcatcagcaagatccgggaggagtacccagacaggatcataaacacattcagcatcctgccctcgcccaaggtgtctcagagcagtttacagcaatgttcaggcgcaaggccttcctccactggtacacgggcgagggcatggatgagatggaattcaccgaggccgagagcaacatgaatgacctggtgtctgaatatcagcaatatcaggatgccacggccaaggaggaggaggatgaggagtatgctgaggaggaggtggcctagaactctccttttctaggtaaagcgggggaggcagtgtgtattcttcactgtgttgtgacagctatgtgtcactacgcacttgttcatttgtgtcttcacatctcctgctgctgcattttaaagcacttttatagtgtgcagttttgactaataaagtattctcacagcaaaaaattca

SEQ ID NO: 407397 - DNA, 480 bp, Homo sapiens
ccccgacaacgtaaaaacagccgtctgtgacatcccaccccggggggctaaaaatgtcaggcagcttcattgggaataatgcggccatccaggaactcttcacgtgtgtctcagagcagtttacagcaatgttcaggcgcaaggccttcctccactggtacacgggcgagggcatggatgagatggaattcaccgaggccgagagcaacatgaatgacctggtgtctgaatatcagcaatatcaggatgccacggccaaggaggaggaggatgaggagtatgctgaggaggaggtggcctagaactctccttttctaggtaaagcgggggaggcagtgtgtattcttcactgtgttgtgacagctatgtgtcactacgcacttgttcatttgtgtcttcacatctcctgctgctgcattttaaagcacttttatagtgtgcagttttgactaataaagtattctcacagcaaaaaattca

SEQ ID NO: 407398 - DNA, 224 bp, Homo sapiens
agaaaggaggctgagagctgtgactgcctgcagggtttccagctgacccactccctgggtggggggactgggtctgggatgggtaccctcctcatcagcaagatccgggaggagtacccagacaggatcataaacacattcagcatcctgccctcgcccaaggtgtcagacaccgtggtggagccctacaacgccaccctctcagtccaccagctcatagaaaa

SEQ ID NO: 407399 - DNA, 988 bp, Homo sapiens
ggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaaggactctgttgtgtgtaaagttaatgtgattatttttcaaagcagtgtttctaaggggtatttttgttcttttaagtcttgagtgatacaggatatttttcattaaaattatatcactggctttatgacttaatattcaataaattgactttggaaacaaaagt

SEQ ID NO: 407400 - DNA, 975 bp, Homo sapiens
ggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaaattaaattccttcccaaaggaaagggggattgaccaattgcttaagtttcccttttttaaaaggccaaccttttaccttggaaccttggttaacaaggtttggggttccccttggccttctaaaaaatttccaattaaccccccaattaaggtttttgtggaaggtttccggggttaattagaaccaaccccaaccttggccaaggttggttagacaggccaaatgggttggaaaattccccggtttggttggccccaattggccaattggtgaaccccaaccctgtgggggagaattaacccggccaaggccaacccaattccaaaaccaattccccggccctttggccttggaattggggacaacgccccaaccaaccaaccggccttggccccccaagggccccccaaccaaggccaaggttcccggccaacctgccaagcccggacttggggggcttccctggggaaccttcctttttaaggccttgtggccaaggggcctttaaggtggaaaccacaccaaccaacggttggaacaccaattttcaactttggttaacccttgggtggaacaaattcccggttctccccctttggaattacaaaggtctgcaacacttacaaaacaacccacttttggtttggaacccgaaaaaacccaaaattccaaggcctttaattttcccaccttttaatctccaagcggacaactccggcaacctaggtctccttggccttaaaatttttggcgtcggcttggttaggt

SEQ ID NO: 407401 - DNA, 824 bp, Homo sapiens
ggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcaccatcaacatccgccttgctgatggaagccacacacgctgcccagcccacagcagtcgcacgcagccgatgggctcggactcttagctggcaggctaggacacacagtgaacattaatgtactgtgaatcgttcctgataagtgaataaaacattgtgaccaaacaatcagcttattcacttatcaggaatcgactgttctgctaatttgctgttgttgtttttcatctctgttgtagttcactatttttgctgtgttctgttttctcctctcatgcttgggcaaatcactgggaatattatcttcatgtgaccatgaaacgtttctattgagtgaaaatgatatcttaacaaaatctatgcacttgctatcaggaacacaatactggatgtgtcttatatatattgaactatatagtactcgatttcttaaataaagcttaagaaa

SEQ ID NO: 407402 - DNA, 406 bp, Homo sapiens
ggtgtgatttctttttattagggaggtgggagggggatgttgggaggcatggggggtgattaaattatcatttccaaggtgcaagtgtttatttttcaaatctataagtacatagttccaccattttggcacaagacaaaatactcatgctaagcaaaggaagagaaagacaaagccagtttttgttgcttttctaaagcaacaaataattctccaaagaaggggatgaaaatgctagttcctttaagcacttactgactgtaaagttggtccctgcttaaattcatacccatagttttgagtcggtatgacaccactgcagtgtgagcaaggtgaatccgtgtgccatgcatggaccaccttgggataccgcagcgttgcagcgtccactacgggatcctctaga

SEQ ID NO: 407403 - DNA, 1797 bp, Homo sapiens
  misc_feature (925)..(925): n is a, c, g, or t
  misc_feature (983)..(983): n is a, c, g, or t
  misc_feature (1605)..(1605): n is a, c, g, or t
  misc_feature (1608)..(1608): n is a, c, g, or t
catgtccagaagcaatccacagtttgagaaaccaagtttgggtaagatttctggggtccattgctggtttacagggataatcagacagactatttgaaatctatcaggatgatgatgatttctgtcaggcctgatggggctcagctcatgaatagcatgggggttctgggatcagctccctgggacagggcaggcctggaggggtcacctgtaaaaagttggtaagcaggggcattgtcaccaggcttcctcttccatgtcaatggagtctggaggcagagttggaatccagctctgcacctttttgctgtgcaccctcaggcgggtcagcaacctctctgaacacacacccagtctacaaaatagaagaaaaaccctataaggtggtttttggcaggggagaggacatgggaagagattgaataaattagttgtccatcctagcatagagcccagaacaaggcactgaaaagacttcttaaatttttttgtccaacaacatcttggacagttctcatttatgtcaacatgcctggtcctgattttgttggtcatatttgcatgtcatattttaaaccatgaagcataataaccaactaagtaagaaagccctggcaaaaaagctgagaggtctggtgcagtggatcacgcctgtgatcccagcacgtttggaagccgaggtgggcagattgcttgagcccaggagttcgagaccagcctggacaaaatggcaaaaccccatctctgctaaaagtacaaaaagcagctggatgtggtggcactcacctgtaatcccaggtactcaagagactaagacacgagaatcacttgaacccaggagacacagggtgcagtgagcctcctgcactccagcctgggtgacagagtgagactctgtctccaaaaaaaaaaaaaaaaaaaaaanttgctgagaaagccctaattgttgttgttgttgttgttgttgttgttgttgttattgntgaaatggggtctcgctatgttgcccaggctggtcttgaactcctgggctcaagcaatcctcctgcctcagcctcccaaaacgttgggattacaggcatgagccacctcacccagcccccttgtagttttaactgtgttctacagtaaccctagaatttgcctccttattttctattaaaatgagacatacttgaacaatattcagtcaaaatagaaatatatacagtcaaaagcaactgccacataattgccaaaacttggaagcaaccaagaagtccttcagtaggtggatagacaaaaactaatggaatattatttagggctagaaataaatgagccatcacgtcacaaagagacatggagaaaccttccatgcatattactaagtgaaagaggccactctgaaaagactacctattgtttgattccaactatatgacattctagaaaagttaaaactatggagacagtaaaaaggtcagtggttgccaggggctgggaggacagagggatgaaaaggtggaacagggaggatttcagggcggtgaaactactctgtgtgatattacactggcggatgcatgtcactgtgcacttgtccagacccacagaatgtgcacnccnaagtgtgaaccctcgtatggactatgaactctaagcaataatgacatgtccgtgtagggtcatcagttacacatgtaccagtctgatgtgggatgatggtagtaagggaccctgtgcctgtgtggtgggaggaggtgtgtgggaactctgtacttctactcacttttgctgtgaacctaaaactgctct

SEQ ID NO: 407404 - DNA, 252 bp, Homo sapiens
attagggttggagctgtcctggacattgcaggctgtttagcagcatctgtggcctctatccgtttgatgttagtaggaccttctgtctcactagtaacaacccagaatacatccagacactgcctggtgtcccatggcaggcagagctgcccctgatggagaccattgatgtttatcattagattactctccataggttatctgtactaattgactttctcactgctactctgtaggtgtgctgtgccctct

SEQ ID NO: 407405 - DNA, 370 bp, Homo sapiens
gtctaaaataaagtgctccttaaacattgtttctcaaatcttccttttttgcctccagagatgtgttgatgacccatgcccacaggacatatatcgccctttgacctctaatgttgccctaattgccacttcctctgtctcctccagaaaacacagatgtagactcagacttccatctggactaataggaggagacaggctgtgaagagtgtgtgtgtgtgtgtgtgtgtgtgtgtgtgtgtgtgtgtgtgtgttggtggtggtgggacaggaaggtggtgcggatgtttaaaaatgttgggaccacgcattcaggacagaatggaagtgtctgggctttggcatccacccacccactctagggtccaga

SEQ ID NO: 407406 - DNA, 535 bp, Homo sapiens
gccaccacggaaaccgttagtttcacattttcctagaaggaattgaggggagtggggtggaccgcgatgcattttaaaggttgggaaagagctaagccattggattccttttcttgaaggaaggagtggaattgtgtaagataattgatacagataactttttcaccctaaaaaattctaacacttctttcagcagttaaatgccaaatttagtgtgtacctgttttacttcattctttagctgtaggttggagtggtgtgagcgatctgcagaactggcattagaggggcagaagaagtagacctgataattaaagtttatgccttaacattttagatctggtttctgatatgctctcttagtaaatctgagtgtgtctttaaaaacgtaaacccaaagcaatttaaagtttctctttaaactttgcaactcgcgaatgagaagattgaaattatttgtaggtaattgcactattccgattttttaatgtatgaggcaaacaaataaattctatgtacagtgtgctgtgaatgg

SEQ ID NO: 407407 - DNA, 176 bp, Homo sapiens
ggactagtttttatctccgagatccagcctgctgtctagggtactcgtgcatgtgagtaaaacttccaagaatgccacctccctacgtatctcccctacactgctctcctcctgcattccctgtgactctaaagtgaggcctaaggctctgatgggatcacccagcttccaccaca

SEQ ID NO: 407408 - DNA, 510 bp, Homo sapiens
cagagggacttccttattatgctgactcaatcagattgaaatttcctgttttcaggggaaaaaaatggtctgcttgggatctgtctgtttccttaaagtttcagtatgattgtgtaacatttggcatgagtgactctattgtggtttaatctggtttgttggagtctagtgcgtgagctcactccaaaacaatgacctcccacaatttttgtttacacacacacacacacacacacacacacacacacacggtatatattcactttttttacccctattggttctctttctctggagaaccctgaataatatgccaactttcctctttcctctataatcaacttcaatgaatatttctgtacatgtatccttgtgctcatgtcaaaaaaagcatttatgattatccttatgagtaaaattgctgcttctaagggtctaaacatcattatgaaatattgtaatattgctctccaaataaatcataccaatttattgtctaaaaaaaatgta

SEQ ID NO: 407409 - DNA, 267 bp, Homo sapiens
gcaggtgagcttgcactctaaggctgaagacagttctgggtcagacacttggagtatcatttataatctgaaagttctgcttttcatacctaattccctagcattctgctttttaaatgatcatgggatgtttgataaatgaatgcatgaatgccatttcttttaggtaaagactggtttactcttctaattccattttgcctaaactagccttgagttgtttgtgttccccaagtgtttactcccagcaagatggaggcagcccac

SEQ ID NO: 407410 - DNA, 1320 bp, Homo sapiens
actgtgaacgataactgccttacttttctttatacttccccaacctgggtacccatccacatcagtatattttatttttgcatgttttttatgcaaaccaatatgtgattttttttttttttttttttgagacagagtcttgccctgtcgcccaggctggagtgcagtggcgtgatctcggctcactgcaagctccgcctcccgggttcacgccattctcctgtctcagcctcccaagtagctgggactacaggcacccgccaccccgtccggctaattttttgtatttttagtagagacggggtttcaccgtgttagccaggatggtctcaatatcctgacctcgtgatccgcctgcctcagcctcccaaagtgctgggattacaggcgtgagccactgcacccggccaatatgtgatattttatattggattttatttaaactcagttatgaaccttacatggaatgatagttaattcactttcttatttagttgattttattatttagaacagtggttgtttacccaaaacattgagcagataatccagagttccctcatttttcttccaagctcatagttccccctattttaaacatcttgactggccaggtgctgtgcctcatacctgtaattctaccacttagagaggctgaaatgggaggatagcttggactcaggagttggaggccagcctaggcaacatagcaaggccctgtttcaaaaaaaaaaaaaatgttttaaaccaaggaaaccatattgactgtgtgtagtgtatcctataattgatgcaagaatatattacatgtgaacacgatgaaaattgaagaagccaatattattattacctaaagtccatcttttacatgaaacttcactctttttgggctgtggtttaagacaactacgtgtgtcatgtatccaccatcacagtcttatacagaagcgtgtcacaggcctcaaaatcccctgtgctcttcctaatcatagctctcccctccctcttctgccacccctatttatccctggcaacaaatgataatgttcctgcctcggttttgcattttccagaatattaaatatttggaatgatgctgtaagtggccatttcagacttgcttcctcgatgtaaaaatatgcattgaaggtctctcgatacctttgttgcttgacaactcatgtattttttatttttatttatttatctaaaaaaaattttgtttttgaatggtgtgaacccaggaggcggagcttgcagtgagctgagatggcgccactgcactctagcctgggtgacggagcaagactccatctcaga

SEQ ID NO: 407411 - DNA, 463 bp, Homo sapiens
gaaacaaagagagccattctcttttctggaaccaggaactcccagcgtagcgcagatgtaaaaggccacacagctgatgtgaagtccccataacacagagaacaccgttggcctccgagagtggaatctaatcggccttgctgatctcactgtgggaagtttctgcctcttcttctgtgtcgtttttatctcccagacccgtgggagctgaaggctgccgagtgtggattagtgcacactgccccactcccggcccgttgtgcttcttggtttagtgtgacagtttcagaacaacaaagccctttctccgctcgctgccagcaagggcgtgcttggggctgccaagctgcaaccccggggttctgcaggcaccctgggtctgggctgtgggaaagtcccgctaaccagtacgagccctgcctgtgctcttcaaaagccagctagggttgaccacttggaccat

SEQ ID NO: 407412 - DNA, 479 bp, Homo sapiens
aaaagggttatagcagtacccagtaatcctactgcatcccccagtgcaatccctctccccgtttcctaaagagaggtatttcacgctttctgtttcccctgacatcaacaactcctcccaattcccttactcccagctaatgaatgccctttctccttatttcatggagaaaatagacacaatcagaagagaaattctgtatgttctcatagccacatctaccctcccacctgcatttgtgtccatatgccctgccttccctcctgttactcctgtttgcttcctggacttgtccttgcttctacctaaattaattccccacaattgtgcagtagatgccatcccctcttgcctacttcaggatatttccctagcaattggtccctctctttcatgcataattaaattttccctctctactgaattatcctcgtcagcattcaagtgtgctgtaatttcttacatctcaacaaaaaaaa

SEQ ID NO: 407413 - DNA, 408 bp, Homo sapiens
ttgatgtagaattcaggtctggggaggccaccagtcccctgcccacattagttattctgtgacaccattttcctgtctgcatgatctctttagacccaaggactctgctgcttcgaagtctttcttagagttttacactccatggaaaggctgagtgctggcacattgaagtgttaaaagacttttttgaagactatgatgtggaaaatggtgatgagactggaaaatggtgatgagacaggaaaatgtgagcaaagttctaggctgattggtagagaaggcctgtctgagggggtgtgtcttctgcttgcaccatagaaggtgagatcaaacgtcctactcaaaactggtttcaatgtggatgaagccacacaggcattgagagggttgaaaaggtttatttactca

SEQ ID NO: 407414 - DNA, 1212 bp, Homo sapiens
caaaatttgaaaatacatcaatgactaagcaactttaatcctaagtatatactcaacagaaatgtcttcacttgcatgtgaagagacatacagaagaatgcaccataattggttaatagctttaaagtggaaacagcccactgaaatatcaacaataaaatggataaatatattttatccatttaatagaatatagaagtgaatatgaacaaacgataaacaccacagatcattttcagaaatataatggtgaaaatatacattacataatttcattcatgtaagactcaaaactaggcaaaaatgatgtatggttagaaatcagaagagtggttacatttggggaacagtgacaggatagttactgggagctctcataagaaggtttctatttcctgggtgctggatacagggacactctgtgataaatcactcatttttgcatatatctatatttcaattttttaaaagggtggtccttaaaagattatgatttagggtttaccaccttgcccctctccatcaattcaaatatttcttccagttcagatcccacaccttacatgaagcctttcccaaccatttcagccagaaggaatttctctttcttcctggtttttatgccatgttctctgggaggtagtgtaatatagtggaaatagtataggctaaggaacttggactttaatctgtgtggcaataaagagcagaagagtgactcggtcagacttgtatctacctaccacaaatttaaccaattttacttatatttctctgtgaacaaatatgaaaatttatacacatatattaaatataaatatatagcttttataccacggaatactactcagccataaaaagaaatgaaataatggcattcacagcaacttggatggagttggagaccattattctaagtgaagtaactcaggaatggaaaaccaaacatcattatgttctcacttataagtgggagctaagctatgaagatgcaaaggcttaagaatgatacagtggacttgggaactttgttgggggcgggtgagaggggggtgagggataaaagactacgcattggctacagtgtacattgctcaggtgacaggtgcaccagaatctcagaaatcatcactaaagaacttatccatgtaaccaaaacccacctgttccccacaaactattgaaataaaaatttaagaatacataaaatgt

SEQ ID NO: 407415 - DNA, 675 bp, Homo sapiens
ctttagtgttttcaggtgagattgcctaaatattaacccttttcttggcgatgcctgtgtttcttatcgaaagattgaacggtatcaccagtaaaaatgagccaactggctattaatggttaatacagcccctccccccaagttcagcttcttttttcttctcctgtccccctcccaacatgttcctgtctcttttctctttttctcaagactatagttgttaggagtcgcttataagtcttataaaatattttgatatcaattacttcccatcaataactatatgtaattaaatttaaattattaagctttttgggtttttttccccccgtaataaaagaatatagttctaaaatcctgattatggtccacactgcataccatctgtgcaattaccaactcagacttaaggttctatatttctgtgtttttgtctctccccagtatgattctatatcttctttactggtgctgggggttttaggtcaccttttacataaaccctgcagagtggtcacattgatcaagttaatgtttcaatatttacaatgtgggaaaatgaaagtgtaatgcctcaggttgtgagtacttaagacgctaaaggctcggcttagttgagtccctatatattgtacttaaaagtatttagcagtggtagagcaacgattttataga

SEQ ID NO: 407416 - DNA, 770 bp, Homo sapiens
gcggcggggaatgcggccaaagcccgggaagctgctgcgggggcgatggctgcgccgagcccggggccccgcgaggtcctggccccctcccctgaggctggatgcagagcagtcacctccagccggcgggggcttctctggcgcctccgagacaagcagtctcgcctgggcctgtttgagatcagcccggggcatgaactgcatgggatgacgtgcatgatgcaggcagggctgtgggctgccacccaggtctccatggaccacccacccacggggccgccctcccgggacgatttctcggaggtcctaacccaggttcacgagggcttcgagctgggcacgctggccggccccgcctttgcctggctgcgccgctccctgggcctggcggaggaggactatcaggctgcgctgggccccggcggcccctacctgcagttcctcagcacctccaagagcaaggccagcttcttcctgtcgtgagcttgcggcaggggtggggcaggggtgggagtggtacccctggctgggagggcagaattcccagtggcggggaaggccccctgaagagagaaacagagcggccctaatctgggagggtcagggccggatggtggacagatcggggaggagaggagggcgagggccgaaggcgagagaggcggtgccgagacctgggagcgagatccacgtgcacaggtcggggaagggggccgggtgggagccgctccagccaggcctgggcagtgacctctttctcttgcccccca

SEQ ID NO: 407417 - DNA, 1766 bp, Homo sapiens
gtttaggggtgggatcgggtcgggatccggaccagccaaggaagggtccaggtgccgcggatcttgagaaggaggcgtggcctggcgctgggattggcgccggatgcaccccgggttgtggagtttggggatcctcatccggcgccctctccccttccaggagtgcacagtctgcgggtggaccggggaaagaagacgtacttcatcgtcatgcagagcgtcttctaccccgccggccgcatctccgagaggtgagtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaacggggtctactactgatctcaggtgagctctgccctcctctgaaagtcacttttctcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgccatgtgacag

SEQ ID NO: 407418 - DNA, 2210 bp, Homo sapiens
gcggcggggaatgcggccaaagcccgggaagctgctgcgggggcgatggctgcgccgagcccggggccccgcgaggtcctggccccctcccctgaggctggatgcagagcagtcacctccagccggcgggggcttctctggcgcctccgagacaagcagtctcgcctgggcctgtttgagatcagcccggggcatgaactgcatgggatgacgtgcatgatgcaggcagggctgtgggctgccacccaggtctccatggaccacccacccacggggccgccctcccgggacgatttctcggaggtcctaacccaggttcacgagggcttcgagctgggcacgctggccggccccgcctttgcctggctgcgccgctccctgggcctggcggaggaggactatcaggctgcgctgggccccggcggcccctacctgcagttcctcagcacctccaagagcaaggccagcttcttcctgtcccacgaccagcgcttcttcctgaagacccaggggcgccgagaggtgcaggctctgctcgcccacctgccccgctacgtgcagcacctgcagcggcacccgcactcgctgctggcgcggttgctgggagtgcacagtctgcgggtggaccggggaaagaagacgtacttcatcgtcatgcagagcgtcttctaccccgccggccgcatctccgagaggtgagtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaacggggtctactactgatctcaggtgagctctgccctcctctgaaagtcacttttctcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgccatgtgacag

SEQ ID NO: 407419 - DNA, 2023 bp, Homo sapiens
gagtctgggaacgtgcctggcttgaactcatggcctggtgctggtgatccagagtggatgagatacactcaggccttgccgtgggtcactcttgtccccctggcatccctgggaggggccgccctcccgggacgatttctcggaggtcctaacccaggttcacgagggcttcgagctgggcacgctggccggccccgcctttgcctggctgcgccgctccctgggcctggcggaggaggactatcaggctgcgctgggccccggcggcccctacctgcagttcctcagcacctccaagagcaaggccagcttcttcctgtcccacgaccagcgcttcttcctgaagacccaggggcgccgagaggtgcaggctctgctcgcccacctgccccgctacgtgcagcacctgcagcggcacccgcactcgctgctggcgcggttgctgggagtgcacagtctgcgggtggaccggggaaagaagacgtacttcatcgtcatgcagagcgtcttctaccccgccggccgcatctccgagaggtgagtatgacatcaaaggctgcgaggtgagccgctgggtggatcccgcccctgagggcagcccccttgttctggtgctgaaggacctcaactttcagggcaagaccatcaacctggatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaacggggtctactactgatctcaggtgagctctgccctcctctgaaagtcacttttctcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgccatgtgacag

SEQ ID NO: 407420 - DNA, 1712 bp, Homo sapiens
gtttaggggtgggatcgggtcgggatccggaccagccaaggaagggtccaggtgccgcggatcttgagaaggaggcgtggcctggcgctgggattggcgccggatgcaccccgggttgtggagtttggggatcctcatccggcgccctctccccttccaggagtgcacagtctgcgggtggaccggggaaagaagacgtacttcatcgtcatgcagagcgtcttctaccccgccggccgcatctccgagaggtgagtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaactcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgccatgtgacag

SEQ ID NO: 407421 - DNA, 1049 bp, Homo sapiens
gcggcggggaatgcggccaaagcccgggaagctgctgcgggggcgatggctgcgccgagcccggggccccgcgaggtcctggccccctcccctgaggctggatgcagagcagtcacctccagccggcgggggcttctctggcgcctccgagacaagcagtctcgcctgggcctgtttgagatcagcccggggcatgaactgcatgggatgacgtgcatgatgcaggcagggctgtgggctgccacccaggtctccatggaccacccacccacggggccgccctcccgggacgatttctcggaggtcctaacccaggttcacgagggcttcgagctgggcacgctggccggccccgcctttgcctggctgcgccgctccctgggcctggcggaggaggactatcaggctgcgctgggccccggcggcccctacctgcagttcctcagcacctccaagagcaaggccagcttcttcctgtcccacgaccagcgcttcttcctgaagacccaggggcgccgagaggtgcaggctctgctcgcccacctgccccgctacgtgcagcacctgcagcggcacccgcactcgctgctggcgcggttgctgggagtgcacagtctgcgggtggaccggggaaagaagacgtacttcatcgtcatgcagagcgtcttctaccccgccggccgcatctccgagaggtgagtatgacatcaaaggctgcgagggtgaagtttagaagggtgtccctgctgccctctgcctgagttattaagagcccagattcggccgggcgccgtggctcacgcctgtaattccagcactttgggaggccgagacaggtggattacgaggtcaggagttcaagaccagcctggccaagatgctgaaactctgtctctacgaaaaacacacaaattagccaggcgtggtggtacccgcctataatcccagctactcaggaggctgaggcaggagaatcgcttgaacccaggcggcagaggttgcagtgagccgagatggcgccactgcactccagcctgtgcgacagagca

SEQ ID NO: 407422 - DNA, 841 bp, Homo sapiens
tcactccctgtcccggcccccagacgtacttcatcgtcatgcagagcgtcttctaccccgccggccgcatctccgagaggtgagtggcctaagcaggtttgggcccccatcccagccgaaactcgcggcccgaagcacccacactcactagccagacggtgaaaccgaggcccaggaaggagaaggggcgttcccaagatctggtgggtcagagacagtgacgcccacacccagcatctctggagcactcagtgtgcgttaggcgccgtgttgggcccttcgcatgctttttaattcccagaaggacgctgaggggcagctcttatcctccttcctagatgagaaaccgaggaaggagaaggccacacagctaacatgtggggagcagggactcagacccagcctctgactgcacgtaaccccctgtgccctccagcgctgactctacccacaggttccccgccccccggccattggctgcccccaagccgtcctgttgccaccgcctggggttggatccctgtgtctgggacaccctcaggggtgacaaggtgtccagaggcaggcacaggcagggctcaagcctgggctgggccaccagtggcctgagtgtgaatgcctgctctgctcttatctttaactcagaaacaataataggccggggttcagctatagggccgggcatggtgcgtcacgcttgtaatcacagcacttttggaggccaaggcaggaggattacttgagcccaggagttggagaccaccctgggcaatagagtgagaccctgcctctacaaaaaatgaaaaagttagctgggtgtgatggcacgtgcctgtagtcc

SEQ ID NO: 407423 - DNA, 1706 bp, Homo sapiens
gtttaggggtgggatcgggtcgggatccggaccagccaaggaagggtccaggtgccgcggatcttgagaaggaggcgtggcctggcgctgggattggcgccggatgcaccccgggttgtggagtttggggatcctcatccggcgccctctccccttccaggagtgcacagtctgcgggtggaccggggaaagaaggtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaacggggtctactactgatctcaggtgagctctgccctcctctgaaagtcacttttctcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgccatgtgacag

SEQ ID NO: 407424 - DNA, 2140 bp, Homo sapiens
gagtctgggaacgtgcctggcttgaactcatggcctggtgctggtgatccagagtggatgagatacactcaggccttgccgtgggtcactcttgtccccctggcatccctgggaggggccgccctcccgggacgatttctcggaggtcctaacccaggttcacgagggcttcgagctgggcacgctggccggccccgcctttgcctggctgcgccgctccctgggcctggcggaggaggactatcaggctgcgctgggccccggcggcccctacctgcagttcctcagcacctccaagagcaaggccagcttcttcctgtcccacgaccagcgcttcttcctgaagacccaggggcgccgagaggtgcaggctctgctcgcccacctgccccgctacgtgcagcacctgcagcggcacccgcactcgctgctggcgcggttgctgggagtgcacagtctgcgggtggaccggggaaagaaggtgggtgaagccgaggcgaggtggctgggcggagcgggcggctggagggcgacagccggcctccctcactccctgtcccggcccccagacgtacttcatcgtcatgcagagcgtcttctaccccgccggccgcatctccgagaggtgagtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaacggggtctactactgatctcaggtgagctctgccctcctctgaaagtcacttttctcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgccatgtgacag

SEQ ID NO: 407425 - DNA, 1725 bp, Homo sapiens
gtttaggggtgggatcgggtcgggatccggaccagccaaggaagggtccaggtgccgcggatcttgagaaggaggcgtggcctggcgctgggattggcgccggatgcaccccgggttgtggagtttggggatcctcatccggcgccctctccccttccaggagtgcacagtctgcgggtggaccggggaaagaagacgtacttcatcgtcatgcagagcgtcttctaccccgccggccgcatctccgagaggtgaggggcagagtgtgtggagcaccgtggctggcacatgatgagcgctcaggtgggggcactgatgctccggcagggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaacggggtctactactgatctcaggtgagctctgccctcctctgaaagtcacttttctcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgccatgtgacag

SEQ ID NO: 407426 - DNA, 226 bp, Homo sapiens
cttaaccaaaccacaaccgcctataagacttaattcaaatgtaccctccatgaaactttctctgactgactttattgccatactcatctcatagggttagtggtgcttttttccttctttaaaatatcaagtcctcctttccccctaaaaactccacattcagccttgtatgatgattagatatgcacttgagagccagcttctgtatctcatgtctttttaagaa

SEQ ID NO: 407427 - DNA, 756 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagattgaaatcaagaaaaaattaaaacagccaaaagaaaaacaaaaaaaaatgggggatattgtgggggggggaaaggggttga

SEQ ID NO: 407428 - DNA, 4635 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgcaaaaaaaaaaaaaaaaaaaaaaaaaaaaaaaaaaaaaaaaaaaaaaaaaaaaaaaaaaacaagaaacaaacgaagaaaaaaaaaaaaaaaaagggggggggaggtagggaaaaacagacagcagaagcggggaccagaaatgtaatgagacccacagtcataaagaaaagaaggcagcccccaaaaaggacatgaac

SEQ ID NO: 407429 - DNA, 4304 bp, Homo sapiens
tcagcaagggacaaagtcctgccgtggcttccttgctgtccctttgaccaagtgaccctgcttctccttcagggtctctgcatgtgttttttcctttgctggaatgctctttggtggtatagctcggggtatagctgataccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407430 - DNA, 5022 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgcatcacactgtagccactttgccaccacctccccacatgtagccgctgaaacccccacgagatgccaatgcacacagcagggagaaaagccaaccaaagaagaccgaagggtatctttccacccgagtagcctctgtagtgattgggaccaagactaaggacttgtctccaatctcagctgaggcagtgcctctgaaccaagatcttggtcaggcattaagacactggctttgtcctaccaactaggatttcttggtggttcacactatttcttgtgctggggaattccctcattgggcccctcctccctccacagtgtggtttcagtgttgaagggtgcagcacccaaggttgtttttatgcattttttcagttccttccaagaagcaaaaaggccagtgtccatctgcctagttcataatgtttataggtctgtttgtctgtcttgcttctggcaggtgtagggaaagtctactgcctgccactcccttcaaaaagaatgtttttgcttttgtgaagtcctgacttgccactcaaactgtaccaatattgtaaataaatgttatgccattttaaaaaagggat

SEQ ID NO: 407431 - DNA, 3752 bp, Homo sapiens
agactgatgcagatgaaccctatagcttagctcccacatatgagtgaaaatatatgatgcttggttttccattcttgagttacttaacttcgaatgatagtctccaattctatacaggttgctgtgaatatcattatttccttcctttttatggcagcctcatttgaaacagctcatactactggtcaggaacaggatcctattacaagtctttgctggtgcttcatttacttctcctcctaggccagtcacatgtactttggttaagttttgaggagttgatattatttttctgtcttgttctgtttttatgatgaacattttttccagtgcccctttgttcctcttaggaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407432 - DNA, 2753 bp, Homo sapiens
tgagcttatggtgaatgagaggaggggctggaggtgcagttctgtggtgcatgctttctgtttcaggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407433 - DNA, 3048 bp, Homo sapiens
  misc_feature (2984)..(2984): n is a, c, g, or t
  misc_feature (3017)..(3017): n is a, c, g, or t
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaccactgggagcacaatgcccacatcattttaagaagagtttatgtgcagcatttaaatccactgtgtttttccttgttaantaaaacagacatgggctttgatttttttcatantattagaccatatctcataaaaccttttgaa

SEQ ID NO: 407434 - DNA, 1940 bp, Homo sapiens
tgcgtcgggccagtcaggataagatgacacatggtcttgagatgtctcctacgagaatcctggttcatgattagtgtcttgagattctcaccatactcatcatatacacagcccgaggcaggtcaagcacgtacgtctgccttcctagaaacgaatagtaccgaggaattgcgcagttgactggacgtgtcgagttgaacatgaagcactctattcagacgagtgagtgccagaaccgaggctccgaatattcaaaacttactgcacccgagactggaagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagctgagctccttgccaaaaaacagccattaaaaaccatgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407435 - DNA, 473 bp, Homo sapiens
ttgctgctttgaggaaaaccccactagctgctgatgggtcggctgtggtgcttgtgatgttagtttggtaggtgggaaagaatctggcagtaggactctgtgagtgtcaagcaatctctaaaacaacttattttctctctcagtccagagacccagctgttcaagctgccatcttggcccagctgaatgcaaaatacggttctggagtgttaccagatgctccaaaggaaatgagcaaggcaagtgtggtaccaccctgttgcctgctgagtgaggctgctggctgagataccgaacaagtaccttgtctagtttgggcttgatttttccaccttgaggaacagggagtccctcttggagtcccttctccatcccagttatttacagatataatcaacagacaaccttaattccaaacctgacaccactacttgcctagggccttgactatgtccttcagcagctggcttcca

SEQ ID NO: 407436 - DNA, 4439 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407437 - DNA, 4385 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407438 - DNA, 4420 bp, Homo sapiens
tctgggtaatgtagtgagagctattttgtaaccatgtggacagaacctagagctgcctgcctgtgggtgagttgggacaccaaggattaaggcagagccaagaacagaaagaagccagacttctgacaccatctgtgctgctgaatcaggcattccctgaggccagacctgcttctggacttttcagtcacgagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407439 - DNA, 4044 bp, Homo sapiens
ataatcaggcaggtgtccttgtgtgattaaacacccaaaggaagactgtcttcctgagtccatgaccagcaccggagttttgggtccatggataaaacgcatctcctgtctctactagaaaagcaaaggacctgaaattaagagaaaggagagattgaagggtggcaccaagattgaaaggagaaagtggttaagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407440 - DNA, 3841 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaatgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407441 - DNA, 2538 bp, Homo sapiens
agcggctttcctcttcacattccagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataagctgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 407442 - DNA, 2381 bp, Homo sapiens
agcggagcgcgcatgcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtccacttctctttcttgatagctcttggtggacagttgtgactggaagaaactaactgcgtactgaaaaacctgtggtaactcttgtgcgacttccccagacccccaggccacagaggcggcgggggaacaaaagggccggaacgaaagagaaaacaggaatggggacacggccaccaaaagggccccca

SEQ ID NO: 407443 - DNA, 1808 bp, Homo sapiens
ttcacatgtcagaaaagttgttggtgtgcgtcccaatggggcgctgggagggaacaggacactcctggggagcggcagcaggaacccctgccaggaaggcctggggcacagtgagtgccagcaggggccatctgggcacagctggtgtctcggggtgggggggggggtgcagccccagcagggatcctaaggcagcaggagtagagccagctagaagctgagtggctgtggcatcattgtcactcgggtgggacgtgggtccatgagagcgtgcaattatgaccacactgtaactttgagcagagaaagtgggaatttggaactggattctctttagagccaggaagagcctcctgaggcggccagatgtctgctggtggccgcccagccacatgcttgtctgcctgagtgcaggtctaggaagcctctgggcatcccccagggtggggtctgggccgctgagctgtgtgctgctgctgggccaccgtgggccttaccttgacggtcactctgcctgctagggggtttccctggagctgtgggcatttccgtgcactgactgagcagaggcaagggctgccctgtccgccaggggcagggtttgcgggccttcctttccccacggcgaggcatgggtgaaagtggccatggcggcagggttaggggcaggtgaggagtgggagtcgcagcaccctaggggcctccatccgcagccttgggagactgacgctcctcgaacatgaatagaatgtggagaccacaacccccacacatgtcgttggttcaggtcgccctgctttgcctgcctaatggagcacatcttgctgccagaacctcactggcctctgggggtcggcaggtgcagagccacctggacgcctggagaccacctgggatgtttcctctgtgactgggaatggccttgacaacagagtccagccaagtctacgttattttctcatctcctgacaacactggatgtcatatttattagtcagcctggtctggagtgaaagaccgtccctagcgcatctcccacgcgccctgggctcctggtgtgctgggtgccagcctgggagcccagcgcttctgggtgatgccccagggctcagaggccctggatggctttggtctcgagacagctgggggaggggccctgcttctgattgtcctgggccccagcccccacctctgcaagggatcggtgtgatgtgctccataatcgggtggggtgtgtgtgtgtgtgtgtgtgtgtgtgtgtatgtatgcatgcgtctggcacatggcaaggcccaagccaacccggcaccccgtagatgggcagctacactgccacccaagcacggagatgtggccgcggcactgggtcccccagtgggtcccatgggggaagaacttccctttgctggggtgggcagcctgccctgagctatcaacactggatttgttgtcttctgcacagctactgtgaagataacgtaaggagaagtggtcagttttcattttataactgacacagttgggacaaaatatatacgtgtacatatatttaagacactaattgtgtgggagagtttagtagaggcctgtgcagacacaaggcaaacagcgtcagcagcgtgggggtctcctgggccagctcggcacctgtgggtgctctgaccctgggggtggggacagctccgtgctaaccccagcagacagttgttggtgcacagtgtctaggaggcgtgggaatgggtgctgtcttcctcttttcacatcatggcgacagtaataaagcccacctccagtggaaaaaaaaaaaa

SEQ ID NO: 407444 - DNA, 334 bp, Homo sapiens
actgaatgccagatatgtgcaagaatttgcgggaagtattgtagggaattcaatggtgacagatctaatctccaccttcaaagagtttgtaataggaaaatcagtcaaggaggcaaatattgaccacataaggaagactctataggctataaaggagaattccactaacattgcgattattatgtgaataactatccctccaattaattgaacataggccgcatgccaagcattctgccctgtgccatacaggtatcagtgccttcaatcctcacatctcccctgcgacttagttgatattttctttcacagatgagaactctgcggctcagca

SEQ ID NO: 407445 - DNA, 157 bp, Homo sapiens
agatattccagcatgaggtatttctttactgaaatgaaatgcaatcattattacatactaaattactaagataatttgagtctatttctggccttcttattctgttacattaatctttctgttggcttgcctaggtacctcactgttctaattactg

SEQ ID NO: 407446 - DNA, 766 bp, Homo sapiens
caaacagtcttcttaaatgtcaacatagcaatacaggcattttccctcattctcttttaatcaaacactttcctccaggctcctcatttttctacaaaaatcactaagtctcagtgacgttctagatttccttctctgtgccctgttctcaagggtcagcctcctcttcacactagagccatgttgggctttcctgttgggagtggggatgtgggagaagtcacctgatagactgagtcagtgcccccatggagccgacaggggaataagccaatgggttgagtgtggagaggtggaatttcaggcactaaggaactcagaggagtgccagggtatgcatggggtttgatgaagatatttggggccacgtaccttcccatgggctccttgggctctaccttgcgagggaccaattgctctgccctgatttgtttagtcctaaaagactcaggataagcactgggttttgcctcctggtagttccaaagtgtgccctgttgcttagagacaggggatggtgcctggagtgaagataaggttgtaaaggaaaccaagccacaaattcccttgtttttgttcaggttgctggacagaagagtaaaggatttttgctctgacagttggaagaaagtgttttcttttctgtgtgtgtttttaccaagttgatgtgttatccaagacacagccgagttagtacccacgttgacaaacagtgttgagttttgcatggctaccttcctcttaattctggtgttcctgatttagg

SEQ ID NO: 407447 - DNA, 647 bp, Homo sapiens
  misc_feature (471)..(471): n is a, c, g, or t
gacaaaatcatctaacacaaagcctactttaaaataaagtattgaatatctcatgtaatttattgaatactgtactgaaagtgaaaaacagaatggttgtatgagtactcaaagtatggtttctactgaattcatatcacttttgcaccattgtaaagtcaaaaaattgaaagttgaaccatcataaattagggaccatctgtacattacccatgtcaatgacaaataagacaaaactaatttctatttgctgttgaaattatttttattcacaaatctctccatcttgacattagtcaccattgaatctcaagtgcagcgtaaactgagaatgcatctataattatgggttgaattttgcatgagctacaggaggcagccaggtggggatacccactgtcctgggggcaggagacactggttttgatttttgcagtgatattaagatcaaatagctgagggatttttttnttttctttttggaacccgggttgtaggggagagaaagtgtagggtgggaaagagataagaagatgggagaaagtggatggggagctgatgataacttacatttgtgaaatggaattggagtttgataaataaaaaatactgattttattcaaccaaagacattatactttttctgc

SEQ ID NO: 407448 - DNA, 334 bp, Homo sapiens
gttttatccatgatgtctgcagcacagacaggttcagtaatttgctcatggtcacttgagataataaaaccccactctagggaacctctcatgcctgcttctggctgtcaccttccctctccactttcctcctgtccccttcctctccatctcctttatgaggccttctttgctgtcccatctcttctttgtatttttactttttattaatttttttttgtggggggggggaatggggtctcgctatgttgtgcaggctgatcttgaactcctggcctcgagctatcctactgtctcagcctgagtagctgggattacaggtgtgagccaccat

SEQ ID NO: 407449 - DNA, 835 bp, Homo sapiens
cagcctctcagcaagacgcaagggcctcccccagccggcatcaggccttgctaaagggtgaggagtctctagtttcggcccctcaccaacctcctctgaaaatgtcagagcaaccctcccctcctcccctggggcccagccctagagggggagagcagctcctccccagctgctgccaatttgcacctcattagcaacagcctctccccagtgacagtccctcagaaatcccagactgagcacctcgttggtgctaaatgaaatctgggtgtttgaggagaatgacatctgagctgctaggagaatgacaagtctcagggcttcccagaaaactgggagaacacaggctacagagaagagcattgttcctggaagaaacccacagcttcacgtccgtagttactgacaatcaaagggatattttgaaaggagttgatggctgcaaggtaaatgatgagctgaatgaatgcgacttaattgctgcagaatgccactggaagtcacagggggtgcctcctctacttggaatgcttgaaaaaaagatgtaaaattaccaattcacccctggtcacagacagagaattgggaaagatgaaatacctaaaaaaactcttaaaagtcctttagaagtaagaggaactaagaacaacattgtttaaaaattctgaagaaatacacgaatatgttaacttttctattgttgtaaagcaaaacagaataagcaacttccaggtcactatggtgagctggacacatacttttagcccagctctctccagaaactcccagtaagatgaaagtcaaggaaataaaagacatacatcagaaaaaaaaa

SEQ ID NO: 407450 - DNA, 802 bp, Homo sapiens
tataataatgaaaatgtgggcacagaaattaaaaatgcagtactcttacagtcattgctatgaaaatgaaatctatgctgaaacttacaatgtgttgataaaagtaatctaagaaaacataagtaaatagacccatctcttttcgattggagcattctgcattccagttttcccaaaattgttttgtacacttaataccattcctatcaaagtctcagcagggtttttttcttcttatttttaaagacatagatcatcttactctaaaactaattcggaaaggcacaggtgtagaacagctaaaccaactttgacaaggaaaataaagtgagaggaatcacccttgatgtgaaggcatattgcgtagttacattagtcaacatagtgtggaagaaggatagaaacaaaggttaacaaaacattatagagaaaccagaattagacaaaggtgtgaaaacaattaagtggagaaaaggtagccttctcaaatggcgctgggcatcctgaggtttaaaaaaaaagatcatggacttaatgtaaaatgtgaaactgcaaaacttttagaaaaaaaaaatatttagaatctaggaataggaaaatatttcttagacttgataccaaaaggacaatgtgtaaaaggaaaaattgataaattgcatatcattaaaattaaaaatgtgtgccttgtgaaaaccatgtgaatacaatgaaaagctacagatggagaaaatatttgtaaaccatatattcaacaaagatttctgtctagaatatataaaaactcctaaaacttaacagtaaa

SEQ ID NO: 407451 - DNA, 417 bp, Homo sapiens
tctcttatgaacttgataacaatacatctggttctaataatcctagaaatctctatttatagacattgaatatgttgttgaaattaaataaaatgcatgaacaaaatttcaagatacattgaggctttgctttctcaataaagtatactacaaagggaataaagaaattctttactcaaattaacggtgaattcttttgtcatgagaataggagtttatattcatttcagtgaaagcacataaattgttctagacaagaaaaacaaaactagcccaaggcaatattttcattatagaaaaaggcacatgtccatgaatatctagtttaatattaacaaaagtcactcaattagctatgcatgtgccattgttataaatatttattcacatctcagctaagtaacacttatatcttgt

SEQ ID NO: 407452 - DNA, 467 bp, Homo sapiens
aggcatttaaggaaggaatagggttctaaggcatcctatgcttccttctacttaaagacctttctcctccccccttctataaacaccccaagatctggctttaccccttactactagttcttattacaggcttctacagatccctgtcactccccattattcctggagatcttaggtcctgacttactgctgctttctccagtactactcctgtcatcattcctgatgtgtttaatattgatgtagagaatccttccagttgcatggcatcttaattccttgacttccttcctgtcttccaatgaccttgtcccacacacaatctcagccacttacccgacagtcattctctgggacctcatcattcctaacaaccctccatactctcaatttcaaatattccactctgggaaagcagatccattgcctcctatgattcttcattcccaaccaggacaagcagtcca

SEQ ID NO: 407453 - DNA, 386 bp, Homo sapiens
attaattatagtcaccagcctgtacagtagatctcttgaaattgtttctccttctaactgaaactttgtaccctttcaccaacatctcccattccacatcctcccattctcccccaggccctgctccagtccctgggaacaactgttctactctctgcttctataagtttgattttgtttttagattccacatatgtgtgagatcacatggtatttatctttcttgcctggcttatttcactaagcataatgtattctaggaacatccatattgtcataaatggaaggatatcccctttttaagcctgagtaggattctagtgtgtgtgtgtgtgtgtgtatataacattttctttattcatctgttgttagacacttaagttgat

SEQ ID NO: 407454 - DNA, 386 bp, Homo sapiens
aacctggccaacatggtgaaagtccatctctattaataaaaaaattttaattttaattttaattttaaaaaaagagagaggaggactgagaaatgtgtggggggtggggaggggctgtcctttaaaactgagtggctaaggccgggcacgatggctcatgcctgtaatcctagcactttgggaggccgaggcgggcagatcacctgaggtcagggggtcgaggccagcctgaccaacatggtgaaactctgtctctactaaaagtacaaaaattagccagggtggtggtgggtgcctgtaatcccagctacttgggaggctgaggcaggagaattgcttgaacccgggaggcagaggttgcagtgagctgagattgcccgttgcac

SEQ ID NO: 407455 - DNA, 792 bp, Homo sapiens
atttttcaaaacttttctattttcctactcaattttattgatgaaaattagaatgcagtcaagtgccagaaactggtatgtggacttttatggacattattgttaatgtttattttgctagagcagtatttgtgagttgaaaatatttatgtttaaaggtttatctgcatttaaggtttattttatatactttagtattttattttatatttttactttatttcccttttgtgtatattcatttacatttatttatgtatttatttatttgccataaaattttgttcccattgcacgttctagctaggtttctatacaaaaatataaaattcttgtacaattatcttatatcagtttaccttactgaattttcttatttccaatttttttttcagattcttatcttgcattttccggtgaaacaaccatgttatgaaataattatatttttattttgaaaatatatactgcattatatattcttgctttatgacattggcttgaatctctaaaaatcatccactaacactaacactgttgcaagaaggcgtccttacattgtttctgattttactgagaattttcttagtgcttaaccattatcatcatagtaacttttaaaaatataaactatttatcttactaaatccctcaattcctgagttactgagagcttttgtcttttgtttgtttctagtatttatcaagaatgaatctggaatcttctcaaagcctgtgagcctctgttaagaatgattaatttattttaaataaaacaattaaaaattaata

SEQ ID NO: 407456 - DNA, 376 bp, Homo sapiens
tttctcttgataagggtcctaataccattcctgaaggctctaccctcatgacccaattgccccccaaaaaccccacctcccaaccccatcacaccatcatgctggggttagaatttcaagaaatgaacttgagggaacacaaacattcagttcatacagatgacacagaagatttgaaaagaagtcaagtagaagtgctagaaataaaaagtattgctagtaatcaaaattaaaacccagtggccatgtttggtaacagaagagaaaattggtaaattagaagatagaaaaagaaaaaaaaacagaccaaaatgtgacacaggaggcaaaaagatggaaaatgcagaataaaaagagatgtggtggggggtaatgt

SEQ ID NO: 407457 - DNA, 235 bp, Homo sapiens
gtcagtcaagggaatttctatctaagcacttaccagcaatttgagctccttctcttttggtctaggtggctctaaaataacaataaaggctacagtgattgaaattcaccagacttgaaatagactgcagccttcttccttcccaccttcttagaatctttgtcctattcatcttccttacgcttccccgggttctcttacttctggattctaacagtgagttgtgagaagcaac

SEQ ID NO: 407458 - DNA, 234 bp, Homo sapiens
caacctggccaacatagggtgactcctatctctattaaaaagttaataaataaaataggccgggcactgtgactcatgcctgtaatcctagtattttgggagactgaggcaggaggatcacttcaggccaaggttcaagaccaacctggccaacatagcaagatccccatctctattaaaaaataataaaagaggccaggcacggtggctcacgcctgtaatcttagcagtttg

SEQ ID NO: 407459 - DNA, 342 bp, Homo sapiens
cctttaaaatcgccagactcaggcatgaaaatagagtttcagggacagaaggaacaagtcccctcttcttggttaatatttaattgggtgctaaagatttcttggagaggacctctgtacctccagtgacaggcatacaagaggctcctatctctgcaagagatgcaggcacttccctgaataaacgaaaataacatacaattaaatcagactattcaattaataaattactttggtggaccttgcaggccaagtcctatttaattacataattttaacttaacacttgagttagagaacacatttatttaataaatgcaggcctaagtgctagaaggccgt

SEQ ID NO: 407460 - DNA, 572 bp, Homo sapiens
atcacccactcgacaactcctgccccgataaaaatatctacatactcctaagtagattttttggctctaagttagcaagtagagctttttgtatttgaggttttttaaaatgcatatacccctgaaaggattaagacaagatcatcagtcattgtaaccttatgtgaatgtattaaatcaaattatatttgctagaacactccatatggagatgtttaacactgaggaaacagaagggagggcaatttggaagcaaataggaagagatagcccagttggaaagaggtactttggcagggtacggtggctcatgcctgtaattccagcactttggaggccgaatcaggaggattccttgagccaaggagttcgagagcagcctgggcaacatagtgagacctatctctactaaaaattaaaaaatcagccaggtgtggtgacgtgtgcctgtagtcccagctacttgggaagctgaggtgggaggatcccttgagcccaagaggtcatggtttccgtgagctatgattgtgctagtgccctctagcctgggtgacaaagtaagaccttgtctc

SEQ ID NO: 407461 - DNA, 363 bp, Homo sapiens
ttgatggtgaggaagtcccaaggggtgggtttgagctcaggaatcaatcaagccacacctggctaaagaaaagtagacccagctgatccttctgaggctgaaaagcagtgaagccaggtgtgttggcacacatctgcgatcccagctcctcaggaggcagaggtgggagcatcactggatcccaggaggttggggctagcctgggcaaaatagcaagaccccatctgtttttctttaaaaaaaagaggctaagtgcagtggctcacatctgcaatcccagcactcgggagggtgaggcaggtggatcagttgagcccaggagtttgagaccagcccgggcaacatggcaaaaccccatctatt

SEQ ID NO: 407462 - DNA, 748 bp, Homo sapiens
gtacattgttactctagagggttagtaaaccttgggcagagtattgggatcttgataagaccacgtaaaactcggcctttgaaatttcttccctactttgcctcacttaagtgttaaaattgctgcctgatgaaggtttggatctgtgtgcccacccaaatctcatgttgaattgtaatccccagtgatggaggtggggcctggtgggaggtgattggatcatgggcatgttttctaatggttgaacaccatccctctgggtgctgttctaatcacaatgagtgagttctcaagagatctggttgtttaaaagtgtgtagcacctcccctccatcttccccctgctccaaacatgctaagtgccagcttctccttcaccttctgccatgatttaaagtttcctatggcctccccagaagaaaagatcccagcatcatgcttcctgtacagcctgtggaaatgtgagccaattaaaactcttttttttttttttttaagtaaactacccagtctcaggtatttctttatagcagtgtgagaatgaactaatacactgcctaaatatagccttcctttttattttgttgttttgttcatttcagttgttacagacaactaaaaaccaaagctataatgtgagtacacagaaagattcaccaattcccagccttatttacctgtgctcttttacctttgatcactcattatagagaaaatgtcctccttacacaaagggcagaaacgtatc

SEQ ID NO: 407463 - DNA, 520 bp, Homo sapiens
cttcatctctaatgtggagatgataatacccaattctctgggctgctgtgaggactaagcatgataaataaataaatagcatgattcttgattatggtatgcacccagagagcctctgtccttgaagatttcaatgttatgccattttgattaatttttatgttgattagaaatagctaatattttcactcgttttgcagaagagagaaaattccattgatgattcttcaataataagaatagtgtaggccaggcatggtggctcacacctgtaatcccagcattttgggagaccaaggaggatggatcacttgagcccaggagtttgagatcagcctaggcaatatgacgaagccccgtctctacaaaaaattagtcatgcatggtggtgcatgcctatagtcccagccacttgggaggctgaggtgagataatctcctgagacagggaggtcaaggctgcaatgagccatgatcacgccacagtatcccagtctgggtgacaagtgagaccctgtctc

SEQ ID NO: 407464 - DNA, 308 bp, Homo sapiens
gcccatgtaggtgtttatctgggtctcattgttcactccatgacaatccagatcttttctcagtgggtagcagaggatagagagaagagtggaagcacttcgtattatatcacaataaaatccactgaaccaatacccttcaacttgctgaaaaccattagacaggaccccaagccccaagagtctgtctaaaaatgtaaccccttccaaatgtctcctgctcttctcatgggagctcttagttcaggacacctgagatttcctgtcaaaggaattagcttaagggggtgctcaaggcaggagacacg

SEQ ID NO: 407465 - DNA, 482 bp, Homo sapiens
ccctatgttgcctaggctggtcttgaactcctaggctcaagtgatcctcccccttaggcctcccaaagtgttgggattataggcatgaaccactgcacctggcctgtttttcatttccaaaagttctttaaggagtcctgcctattcatgcgtgacagtatgtaccctacagctttctcatcactgactgcgcgacttctttgaacacctcacacataactatcctctcacctgtatgatgacagtttcaggatctgcgtttctttgtggctgacagcggctgcctgctgtttctgttggccctcagtcagctgactctccttgtgtgcttggggatctttgcaagctgaatgcctgacttacgagcaggaatgaggctaagccaggtaagcttccttcagggagcaggtgctttgaccgctactggtacctgaggatcttggctcagcatgggagacacaggctcatcttcccacctcacc

SEQ ID NO: 407466 - DNA, 295 bp, Homo sapiens
tgtaggcaaatgcagttttactttttaatgaaggacaagtctgttgataacattttgattcttaaaattttttttatcttataaaaatgaaacaatgcatttaaagtgtcttcagctcttatgttaataccaaattatacattttcttagcccatgttcaggagagacaatatatcttccaaattaagagaagctggcaccatttttaaaacaaggccttgaatctgctgtggtatgtgctggtaggaattttgtatgaagctgttattgaagtagatgacattaaggtcaaagg

SEQ ID NO: 407467 - DNA, 864 bp, Homo sapiens
tagctgactctagaggatacacatgcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgaca

SEQ ID NO: 407468 - DNA, 1929 bp, Homo sapiens
ctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggaaaaagttccttacgttaacagccccggagagaagcatcggattaaacagcttttgtaccagttaccaccacatgataatgaggtacggtattgccagtctttgagtgaagaggagaaaaaagagttgcaggtgttcagtgctcagcggaagaaagaagcactgggaagaggaacaattaagcttctgtccagagcagtcatgcatgctgtgtgtgagcagtgtggtttgaagataaatggaggtgaagttgcagtgttcgcctcccgtgcgggccctggtgtgtgctggcacccatcctgttttgtctgtttcacgtgtaatgagctgctggtcgacctcatctatttttatcaggatggaaaaattcactgtggcaggcaccatgcagaactgctcaaaccacggtgctcagcatgtgacgagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgaca

SEQ ID NO: 407469 - DNA, 319 bp, Homo sapiens
atgaggattaattatatctgtgtcacccacacagctcccccatacccataatctttatttattttcttcgtttcttccttataccttgtttcaggcattaaaccataacctgttatttattctatccttttcaaaacaggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccg

SEQ ID NO: 407470 - DNA, 732 bp, Homo sapiens
ctcggtacccctcctcagcagacgcagctctggctcctcagcagacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgaca

SEQ ID NO: 407471 - DNA, 1362 bp, Homo sapiens
cacatttctttttgaagataatttttgctgatgagtgcacagaagctgagggtcgccattggcacatgaaacacttctgctgccttgagtgtgaaacggtcctgggaggacagaggtatatcatgaaggacggccgccccttctgctgtggctgttttgagtctctctatgcggagtactgtgaaacctgtggggaacatattggtgtggaccatgcacagatgacctatgacgggcagcactggcacgccacggaagcctgcttttcttgtgcccagtgtaaagcctctttgttgggatgtcccttccttcccaaacagggtcagatttactgctcaaaaacgtgcagtcttggtgaagacgtccatgcctctgattcttccgactctgcatttcagtcagctcgatcaagagactcccgaagaagtgtccgaatgggcaagagcagccggtcagcagatcagtgtagacagtctctcctcttatcgcctgctctgaactacaagtttcctggcctctcaggcaatgctgatgacaccctttctcgaaaattggatgatctgagtctctccagacaaggaacaagttttgccagtgaagaattttggaaaggcagagtagagcaggaaactccagaagaccctgaagaatgggctgatcatgaagattatatgacgcagctcctcctcaagtttggtgataaaagcctctttcagccacagcccaatgagatggatattcgagccagtgagcactggatatctgataacatggttaaaagtaagaccgagttaaagcaaaataaccagagccttgcaagtaaaaaataccagtctgatatgtactgggcacagtcacaagatggactgggcgattctgcttatggcagccacccaggccctgcaagcagtagaaggcttcaggaattggaactggaccatggggcttcagggtataatcatgatgaaacacagtggtatgaagattccctggagtgtctgtcagacctgaaaccagagcaaagtgttcgggattcgatggattctttggcattgtccaatatcacaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgaca

SEQ ID NO: 407472 - DNA, 360 bp, Homo sapiens
tcagatggcaggggaggcgtcctgaatcttcaagttcccctttccacccattgtcgtcacctgagcagctgttttgttttaattttgctttattgtttaaggaagttcattcatactgattttctcactcaagcctcatggcccctggtgaggtaggtggccctattcctccttttacaatggaagagaaagctcagcgtcagtcctccctcttctccacggctgctcactcccattcccatgttctcactgcagaatgacgtggctcctgtgtgtcaatccccagggaggagggcatagcatctctgccctcaggaaccttccagtctcactggggggtgtgccacatacataaagctg

SEQ ID NO: 407473 - DNA, 746 bp, Homo sapiens
ctgatgtgaaaatccctgcgttcatcaacataacccagttagggtcgcactcatcacggggcccccattgcctctggcgcaccccacgactgacatctgcggggccttcgcgctaggcttcgagtttcagcttccgcaccaggcctgcctttctgcaggggccagggtgggggtcgtgtgctgattgggccctctgaaccgccaccgctgcagaggggctgttccttccgtcacatcccttgtgcccgaatccaccctgtgtcttctcttttctcagcaggacattttaaaagcccagaccccctccttacagagcaaatgtccaggcttcggaggtcactgtcacatcccaagaacccccttcaccaggtgccactcttgagactggactgaagccccctggagagttccacttgcctttgtcctgctgcctgaggtgaggacatggacggccgggtacaagacggggcaggcaacctcgcagtggtggtaaccctgtgcatgaaccctgggcctggcacgtggacctcctgtgaccgtccctacaggcccgtgaggctgagcttggcactgcccaagaccacacagtccatgcgcggtggagctggggtccaggctgcccaccagggcagtgactacaatggtggcagcaggggacggtcaccgtcatgagctcaagccaggcgctgcactgaccttgagggagggctccatgcttccccttcccacagctgcagtgaggccta

SEQ ID NO: 407474 - DNA, 314 bp, Homo sapiens
atagggaatgtctactaatattctttgaatcctctgtaacccctgccataatgtcttgctcaatctatggaaactgtctttctttgattaatgacaagctaatgatagttttatttcctatctagtttgtgaatgaacattgttaattgaaattattatctttagattatctggattcttttttatccatcttagtattgctatctcagaatcacacacgctaatgtaaaaaaagaaataaataaccaaggaatctctgtttgaacacctccagtgacaagggactcactgcccattcttctgctgggcaatgc

SEQ ID NO: 407475 - DNA, 886 bp, Homo sapiens
gctgcgggcctcgcgaccctcctgcttccctccccgccccgcgccgcctctctggtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctga

SEQ ID NO: 407476 - DNA, 749 bp, Homo sapiens
ggtcgaggctggtgtgaatcggccgaggctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcaccaaccccaggggctttttcccccatttaacccctaattttgaaggccaggctggcacctccactggtggagagcccgccgggtataaactttta

SEQ ID NO: 407477 - DNA, 821 bp, Homo sapiens
ggtcgaggctggtgtgaatcggccgaggctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctga

SEQ ID NO: 407478 - DNA, 605 bp, Homo sapiens
gcggacgcgtgggtcgacccacgcgtcggccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctga

SEQ ID NO: 407479 - DNA, 891 bp, Homo sapiens
  misc_feature (847)..(847): n is a, c, g, or t
gctgcgggcctcgcgaccctcctgcttccctccccgccccgcgccgcctctctggtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccacgctctttgtgtgggggggagggggggctagagggagggaaaaaaataatacttttttcatnaagcctcccaggttaataaacttacttggcctaaaaaaaaaaaa

SEQ ID NO: 407480 - DNA, 437 bp, Homo sapiens
ggtcgaggctggtgtgaatcggccgaggctggagttgcgcgggctgacgcgccactatgtagcgggtttcgggcgggccacgcgtgcgggacaggaacccaaccccagccgaccttgagctccaggagttcgtctcttacgttgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctga

SEQ ID NO: 407481 - DNA, 638 bp, Homo sapiens
gctgcgggcctcgcgaccctcctgcttccctccccgccccgcgccgcctctctggtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggtatgttcctagccttgagcggggtgggggaaggaatgagtcagcctggagcacgtggccagtgggaccggagggttccccggcgtctgtttgtcgccaaggtccgaatccggctccccttaactggaaggaaacatccatgtaggggctcaccaaacaaaacagctgtgtttctagtgtggtttcagacttagagaagcagagatccacgaggtattgagagcaacgcggaaaatagtagtgaaccctgtaaaaatcaaagaaaaaaaatcacaaagcaccctttcctgtgcccttttaaggttgacccagtgctttaagaggctaacacagaagggtaaagtaagtctccataaaacccagagaagagactggaaagctcctctttggatcctg

SEQ ID NO: 407482 - DNA, 955 bp, Homo sapiens
gctgcgggcctcgcgaccctcctgcttccctccccgccccgcgccgcctctctggtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctgaaaaaaaaaaccagaacaaacacacaaaaaaacaacccgaggaaataaaataaagtgaaaaaagagtaaa

SEQ ID NO: 407483 - DNA, 774 bp, Homo sapiens
gctgcgggcctcgcgaccctcctgcttccctccccgccccgcgccgcctctctggtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctga

SEQ ID NO: 407484 - DNA, 1670 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407485 - DNA, 1940 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttgctttgttggttaaaaaaaaatttcttttaaaaaaccatcttaaattgaaaatacatttaatacacctgctact

SEQ ID NO: 407486 - DNA, 4194 bp, Homo sapiens
  misc_feature (2100)..(2100): n is a, c, g, or t
ttttgtccttttacggcgtcttcccgtcattgtcatggtgattgtcagccgctgtggcactggtgggagtgtcacggagcatgcaaatgaggttgtaatgaagttggaggccctgcaaaggccaggtggacttccacttagcatcctgctggtcttagctggtttaaccaagaggggagcctctgacctcaggcatcctattgctgaagataggcagagtttgagttgtgcaactgttcagccaagcctacaagatgtatagtgctgtgggggtaacatggcctccctacccagcctcgcttcagaactttcgtaccaaggctggactgtagaaaagtccttcctatgccatggcactttcccactgaggcctcccatgggtgccgtttcctttgctggaaggttctcctcgactcctggcagtctatactcatttaaaggtttccgccttctctaaagcctctcactgctggacttcacggtggatcagatttcccttttataaacattcatagcagactgtacatttctttcactgcgtttaccaaacgatttgatggcgaagtgcgtcagggcgtgggccttctccatcactagcgttccttgcaccccaggagctcaatccgtgtttcctaaatgaatacttgacatttcgcttgatcgtatatttttgcacagcagtgatcttcacgacctttgattaggcagtggcttctcagatacgacaacaaaagcataagcaaccaaaggaaaaaattaattggacttcatcaaaattaaaaactttagacttcaaaggacattctcaaaaaagtaaaaaacaaccataacctagcaaataatacatctgataagggcctaatatccagaatatataaagaattattacaattcaacagtaaaaagacaatccaattcaaattctttaaaatgtttaaagaatttgaaaaatcttccaaacaaaatacgcaagtgaccagtaagtgcatgaaaagatgctcaaggtcattaatcaccagtgacttagtcaccaatgactaatgcatcagtcacttgaaatgcacatcagaacctctgagagctgccaggccacacccagtgggatgactgtaatcagaaagacgggcggcgccagtgaggatgcagggagactggagcctcgtacacatcgccaggggaacaaaaacagtgcagctgctgtgcggaaatgggaaggcagttcctgaaagtgggacgtagagctaccatgtgacccagcatttccaccctgaggggacactcagaagacagggcagatccccagtgacatctctttcccgttggggtttgcttttgtcacagtctccaatagaggtcatcattcctggtgccagaccagctacgatattaccatgcgtgtagcgttttacgtgagttacggagtacttgtgtgttttgtttggtttttccatagctctttgaagtcatagaacagtattattatttgtctccgttttcagatgaggaaaacgagaccttgagagacttttgtttgaggtcatgcacgtagggaatgataaaagtcatagacctgcttagagcagctcacaggcagttataaaacagggtttgatattttaaaattgtatttttacattattttaagtgtttctatatggacacattttggtctttaagagtaattttatgttctgtggcttgtaaaccacctgcttgttttctgtactgggcacttttgtatttttgtgccttgactttgagtgattttatcattttgttaacaccacagagtgtacttcgtaaaccgagatggcgtggcctgctacacacccccgctgtgtggcgcagcctgtgggtcctaggctgcgaggagcaagagctgcactaaatgctgtaggcagctggaacacagtgggaattatttgtgtgtctaaacagatctaaacacagaaaagatgcagtaaaaatacagtgtgagactccgtagggccccatctcacatgtggtcaagtgtgagactccgtagggccccatctcacatgtggtcaagtgtgagactccgtagggccccatctcacatgtggtcaagtgtgagactcngtagggccccatctcacatgtggtcaagtgtgagactctgtagggccccatctcacatgtggtcatctgtagttgaccgaaatgttgtgtaacatgtgactgtttccaggttaattgcagacagtggcacaccctcccctaggttcttcagtttctgttttttcagtcttttgaggtaaaatttgcatgcagtgaactacctacagtattatctgtctgcttgctgctgaggtataggacatgattgccaccccagaaacttccctcatccctcatgtggggcaggccctttcagctgtctggatttgttccactgtgggttgcttcctgcctgttcggtgacttcatgtaaatggaccaccacagtgtgtactttttgtgtctgccttggtgggactcatcctctttgtgtgttttactggtttgttttgtcgtactgatgagaagtatttttccatttttcttttctttttgttttttgagacggagtcacgctgtgtcacccaggctgaagtgcattggcccgggtttgagtgattctcctgcctcagcctcctgagtggctgggattacaggcacacaccaccatgccctatttttccatttttcaaaaacggtttataacaattaacttttacgcattgttgctgcaaatgaggcagtttttagctggtgccgcggaggaaggatgttactcaagtagttaattgggattttcctggtttgttttctcttttatttttacccatcaggtaagacatcttttttcataatgttattttgtttgatgaatatgacttgatatgaataagttgatatgaatatgacttgagctttgggacttacctcaagatattaatttgtttaggcagtttattttgtgatttataaataaaatttttatttcctatgtaacttaaaaaaaattatttccccatagccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407487 - DNA, 1770 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccagcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407488 - DNA, 670 bp, Homo sapiens
ttcatggatatgaaacccaccgtggatatagagggttgattgtatttatttttactcattgtcttcccgctgaactgaactgtgccgctcttggggaagaatgctaatgccaaattaattagatcacccagcatctttgacatgactcagatccaaaaatgtaaacgcattcctccctttctgccccgcagggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407489 - DNA, 800 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgccccgtgggggcccggaaagttcccggg

SEQ ID NO: 407490 - DNA, 1820 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407491 - DNA, 1306 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407492 - DNA, 2447 bp, Homo sapiens
agacggaccgagggccggaagtgacgccagctggcccgcttgaggcgtagggggtggcgctctccgttcggcggcgctcccatggcgcacattaccattaaccagtacctgcagcaggtgggtcctagccggggagcgcgcggcggcgtggttggccctcggcgtgttccgtgtgtcccctcctgccttggaccctcaggccttttcctttcccgcctcgccaccctttttccgttcgggtccccggcgggcagccgcgcgagccgaacagcggcggccgggactcgggaaggcggcccgagttctcccctgcagggccgccgtgggggccgggcggtgtccgtggatcgcggagtcgtcgcggtgtaagtagacgcggcggtcccaggtcgctgccctcacttgctggcacgtgtggccgcgctcccagcccaggcggtccgaagggcctgcgggccacgccgagggcccgctgtgggcggtgctgtgtcggatggacgctgtttcccagcaggatgcgggatgaattcggggactccaggaggcgatggaggagtaagcgcgaggctgtggccgtgctgcaggccgggctcgtgcccctcgtcctcgctgtcgtttaacgcccttcactctccgagcacaatgcacacttcatatcgctcggtacatgcgtctgacagatgttgttcaacagcttgtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407493 - DNA, 1907 bp, Homo sapiens
gagagtagtgaccatctgttacattttgattgttctgtcttctttcaaagtaggggaaaatgaattttcccctgtgtggcattcagtgtattgttgtaggttctattcgaacagaatattttattttctacttaggtttccctttcaaatgtttcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407494 - DNA, 1791 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccacttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407495 - DNA, 2728 bp, Homo sapiens
ttttgtccttttacggcgtcttcccgtcattgtcatggtgattgtcagccgctgtggcactggtgggagtgtcacggagcatgcaaatgaggttgtaatgaagttggaggccctgcaaaggccaggtggacttccacttagcatcctgctggtcttagctggtttaaccaagaggggagcctctgacctcaggcatcctattgctgaagataggcagagtttgagttgtgcaactgttcagccaagcctacaagatgtatagtgctgtgggggtaacatggcctccctacccagcctcgcttcagaactttcgtaccaaggctggactgtagaaaagtccttcctatgccatggcactttcccactgaggcctcccatgggtgccgtttcctttgctggaaggttctcctcgactcctggcagtctatactcatttaaaggtttccgccttctctaaagcctctcactgctggacttcacggtggatcagatttcccttttataaacattcatagcagactgtacatttctttcactgcgtttaccaaacgatttgatggcgaagtgcgtcagggcgtgggccttctccatcactagcgttccttgcaccccaggagctcaatccgtgtttcctaaatgaatacttgacatttcgcttgatcgtatatttttgcacagcagtgatcttcacgacctttgattaggcagtggcttctcagatacgacaacaaaagcataagcaaccaaaggaaaaaattaattggacttcatcaaaattaaaaactttagacttcaaaggacattctcaaaaaagtaaaaaacaaccataacctagcaaataatacatctgataagggcctaatatccagaatatataaagaattattacaattcaacagtaaaaagacaatccaattcaaattctttaaaatgtttaaagaatttgaaaaatcttccaaacaaaatacgcaagtgaccagtaagtgcatgaaaagatgctcaaggtcattaatcaccagtgacttagtcaccaatgactaatgcatcagtcacttgaaatgcacatcagaacctctgagagctgccaggccacacccagtgggatgactgtaatcagaaagacgggcggcgccagtgaggatgcagggagactggagcctcgtacacatcgccaggggaacaaaaacagtgcagctgctgtgcggaaatgggaaggcagttcctgaaagtgggacgtagagctaccatgtgacccagcatttccaccctgaggggacactcagaagacagggcagatccccagtgacatctctttcccgttggggtttgcttttgtcacagtctccaatagaggtcatcattcctggtgccagaccagctacgatattaccatgcgtgtagcgttttacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407496 - DNA, 1312 bp, Homo sapiens
tttcagtgcaggcggtttcactccagagcgttttgtcttctgtggtcataattaactatggaaaagcagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407497 - DNA, 1094 bp, Homo sapiens
gaacggtgacaatgctcaaaggcaaatgacaggtactcctcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407498 - DNA, 2633 bp, Homo sapiens
ttttgtccttttacggcgtcttcccgtcattgtcatggtgattgtcagccgctgtggcactggtgggagtgtcacggagcatgcaaatgaggttgtaatgaagttggaggccctgcaaaggccaggtggacttccacttagcatcctgctggtcttagctggtttaaccaagaggggagcctctgacctcaggcatcctattgctgaagataggcagagtttgagttgtgcaactgttcagccaagcctacaagatgtatagtgctgtgggggtaacatggcctccctacccagcctcgcttcagaactttcgtaccaaggctggactgtagaaaagtccttcctatgccatggcactttcccactgaggcctcccatgggtgccgtttcctttgctggaaggttctcctcgactcctggcagtctatactcatttaaaggtttccgccttctctaaagcctctcactgctggacttcacggtggatcagatttcccttttataaacattcatagcagactgtacatttctttcactgcgtttaccaaacgatttgatggcgaagtgcgtcagggcgtgggccttctccatcactagcgttccttgcaccccaggagctcaatccgtgtttcctaaatgaatacttgacatttcgcttgatcgtatatttttgcacagcagtgatcttcacgacctttgattaggcagtggcttctcagatacgacaacaaaagcataagcaaccaaaggaaaaaattaattggacttcatcaaaattaaaaactttagacttcaaaggacattctcaaaaaagtaaaaaacaaccataacctagcaaataatacatctgataagggcctaatatccagaatatataaagaattattacaattcaacagtaaaaagacaatccaattcaaattctttaaaatgtttaaagaatttgaaaaatcttccaaacaaaatacgcaagtgaccagtaagtgcatgaaaagatgctcaaggtcattaatcaccagtgacttagtcaccaatgactaatgcatcagtcacttgaaatgcacatcagaacctctgagagctgccaggccacacccagtgggatgactgtaatcagaaagacgggcggcgccagtgaggatgcagggagactggagcctcgtacacatcgccaggggaacaaaaacagtgcagctgctgtgcggaaatgggaaggcagttcctgaaagtgggacgtagagctaccatgtgacccagcatttccaccctgaggggacactcagaagacagggcagatccccagtgacatctctttcccgttggggtttgcttttgtcacagtctccaatagaggtcatcattcctggtgccagaccagctacgatattaccatgcgtgtagcgttttacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407499 - DNA, 732 bp, Homo sapiens
tctccgtttccgccaccttcgccacaatcttttcaatataaatactgctattcatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407500 - DNA, 3220 bp, Homo sapiens
  misc_feature (2100)..(2100): n is a, c, g, or t
ttttgtccttttacggcgtcttcccgtcattgtcatggtgattgtcagccgctgtggcactggtgggagtgtcacggagcatgcaaatgaggttgtaatgaagttggaggccctgcaaaggccaggtggacttccacttagcatcctgctggtcttagctggtttaaccaagaggggagcctctgacctcaggcatcctattgctgaagataggcagagtttgagttgtgcaactgttcagccaagcctacaagatgtatagtgctgtgggggtaacatggcctccctacccagcctcgcttcagaactttcgtaccaaggctggactgtagaaaagtccttcctatgccatggcactttcccactgaggcctcccatgggtgccgtttcctttgctggaaggttctcctcgactcctggcagtctatactcatttaaaggtttccgccttctctaaagcctctcactgctggacttcacggtggatcagatttcccttttataaacattcatagcagactgtacatttctttcactgcgtttaccaaacgatttgatggcgaagtgcgtcagggcgtgggccttctccatcactagcgttccttgcaccccaggagctcaatccgtgtttcctaaatgaatacttgacatttcgcttgatcgtatatttttgcacagcagtgatcttcacgacctttgattaggcagtggcttctcagatacgacaacaaaagcataagcaaccaaaggaaaaaattaattggacttcatcaaaattaaaaactttagacttcaaaggacattctcaaaaaagtaaaaaacaaccataacctagcaaataatacatctgataagggcctaatatccagaatatataaagaattattacaattcaacagtaaaaagacaatccaattcaaattctttaaaatgtttaaagaatttgaaaaatcttccaaacaaaatacgcaagtgaccagtaagtgcatgaaaagatgctcaaggtcattaatcaccagtgacttagtcaccaatgactaatgcatcagtcacttgaaatgcacatcagaacctctgagagctgccaggccacacccagtgggatgactgtaatcagaaagacgggcggcgccagtgaggatgcagggagactggagcctcgtacacatcgccaggggaacaaaaacagtgcagctgctgtgcggaaatgggaaggcagttcctgaaagtgggacgtagagctaccatgtgacccagcatttccaccctgaggggacactcagaagacagggcagatccccagtgacatctctttcccgttggggtttgcttttgtcacagtctccaatagaggtcatcattcctggtgccagaccagctacgatattaccatgcgtgtagcgttttacgtgagttacggagtacttgtgtgttttgtttggtttttccatagctctttgaagtcatagaacagtattattatttgtctccgttttcagatgaggaaaacgagaccttgagagacttttgtttgaggtcatgcacgtagggaatgataaaagtcatagacctgcttagagcagctcacaggcagttataaaacagggtttgatattttaaaattgtatttttacattattttaagtgtttctatatggacacattttggtctttaagagtaattttatgttctgtggcttgtaaaccacctgcttgttttctgtactgggcacttttgtatttttgtgccttgactttgagtgattttatcattttgttaacaccacagagtgtacttcgtaaaccgagatggcgtggcctgctacacacccccgctgtgtggcgcagcctgtgggtcctaggctgcgaggagcaagagctgcactaaatgctgtaggcagctggaacacagtgggaattatttgtgtgtctaaacagatctaaacacagaaaagatgcagtaaaaatacagtgtgagactccgtagggccccatctcacatgtggtcaagtgtgagactccgtagggccccatctcacatgtggtcaagtgtgagactccgtagggccccatctcacatgtggtcaagtgtgagactcngtagggccccatctcacatgtggtcaagtgtgagactctgtagggccccatctcacatgtggtcatctgtagttgaccgaaatgttgtgtaacatgtgactgtttccaggttaattgcagacagtggcacaccctcccctaggttcttcagtttctgttttttcagtcttttgaggtaaaatttgcatgcagtgaactacctacagtattatctgtctgcttgctgctgaggtataggacatgattgccaccccagaaacttccctcatccctcatgtggggcaggccctttcagctgtctggatttgttccactgtgggttgcttcctgcctgttcggtgacttcatgtaaatggaccaccacagtgtgtactttttgtgtctgccttggtgggactcatcctctttgtgtgttttactggtttgttttgtcgtactgatgagaagtatttttccatttttcttttctttttgttttttgagacggagtcacgctgtgtcacccaggctgaagtgcattggcccgggtttgagtgattctcctgcctcagcctcctgagtggctgggattacaggcacacaccaccatgccctatttttccatttttcaaaaacggtttataacaattaacttttacgcattgttgctgcaaatgaggcagtttttagctggtgccgcggaggaaggatgttactcaagtagttaattgggattttcctggtttgttttctcttttatttttacccatcaggtaagacatcttttttcataatgttattttgtttgatgaatatgacttgatatgaataagttgatatgaatatgacttgagctttgggacttacctcaagatattaatttgtttaggcagtttattttgtgatttataaataaaatttttatttcctatgtaacttaaaaaaaattatttccccatagccgtgctggtatagaggactctaagaagtggggcatgctgtttctggtgaaccagctgtttaaaatctacttcaagaggtgtgcttctgtttgaatcctttctgtctttacaattttcgattgtcctggacttcccacacacactgcatgccgcaccgtatgcccccccgtatggggaat

SEQ ID NO: 407501 - DNA, 1702 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407502 - DNA, 1827 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcctttgtcgttcatggcagctgtcccgcatagaacacatgcagtggattacttgggacttgagacccggaaacactgggccagttgctcatttctgcagttagaaaggaatgacagtgttttggaacagaagctcgtttcagctctttcacttggatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407503 - DNA, 1867 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407504 - DNA, 1421 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgaggtagagtatgccatccttcctgtttggggttttaaaaatgcaagcctgatgagagttgacgtgcacgctctgtgagaaactcaccctccttctgacgcgcctcccccctcaccagcgagggcaacctgctgctgctgcacgaggcgctggcgaagcacgaggccttcttcattcgctgcggaatcttcctcatcctggagaagctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407505 - DNA, 2270 bp, Homo sapiens
tgtttgaatatcttaaaggcaaccattaatcacaaaacacaacagagaaaagaccctcttattactgtggcaagtgacacagtcatgagttttacatataacgagaaaataatttgccgtatacttgcaaaatatgagtcacgtggctcctagaaacacacctccttctcttccgtaatgggataactttaaatatggttctaagcagcttaagcctgaaaacaaaaattccaccacggcaataaacaaaaccacttgttgcctctggggctcccggccctgcagtggaggcaaacgccctgcctttccgctccccggcgagagcctgcgaggcacccggagcggccgcccggccgcgtctgcgtcacgcggggcaggagcggcgtccccagccccggccgccgcctcacctggtagagctcctcgaggttgtacctgatggaggtgctgctctgcacggcccgcaccgcctcgtgcagcttccgccacgtgtcctgcgtgtagttgtcgggcagccgaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407506 - DNA, 1828 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407507 - DNA, 1791 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407508 - DNA, 1210 bp, Homo sapiens
tgacatgatacgaatcgagtgtcggtccccgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttg

SEQ ID NO: 407509 - DNA, 1173 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacgtgagtaaggacttgaggaccgaccaccagacgctgttggtggtgttttcattgcagcgttcaccctttctggcctgtgtttattgttgacacatatttcatttctacacatgctataatcccacaaccattgttatttttgctttaaaaagttgattgttttgtaaaggaaataagagctgagggaaaaaagagtcttcatttgcccacatttgaccatgcctggagctcctctctgcaggaaccagtttccgtctagtgccatttccctttcctgaggcactttcttccacatttgcgtttggtgagggtctgagggcagtgaatcttttaagctttcatttttctgaaactctcgttattttttttaagaaatgttctctctttaccagtgaagaagcagcactgatcaccttcatttttaaggctccatttgctacatggagtctcgtgggttgacagttttttccttttggcactttaaaaatgtcattccatctggtttcctttgcttctgatgagtccttgccatcgttccctgtatagaatgggtctttttcctctggctatgattttctctttatcattggcattcagtaatttggctctgatgtgcatagttggt

SEQ ID NO: 407510 - DNA, 1675 bp, Homo sapiens
gcaggcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcaccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcggtgcgtttccccgcccgggactcccgccttcgtctgcccggtgttcgctcttcagacctcagatagactcggcagagtgatccttcgccc

SEQ ID NO: 407511 - DNA, 372 bp, Homo sapiens
taccttgggatggggacatggtcttgggattgcaccagggggccagtgtctggatgggagagcattccaggcaggacctctaggtgctgtggggtgggagtggtggccatagagctgtccaggggcccgtgaggagtcaggagcagcagtcacgctgtctttgcaaggcctctgtgcctctgggtgagctaggagcccccatggtcctgactccagcatctcctcccctcctccagatcatagaccccctggcccgtggccgtgccttccgtgtggcagatgacactgcggaaggcctgagtgccccacacactcccgtcacgccgggtgctgcctccctctgctccttctccagctcccgctcaggtttcc

SEQ ID NO: 407512 - DNA, 1506 bp, Homo sapiens
gcaggcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcaccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggtgaggacggggctgggggcggggccggcgggggcgggacctggaggtgcccggcgggggcaggaggccccggactgcggccg

SEQ ID NO: 407513 - DNA, 653 bp, Homo sapiens
gaaagccgaggctcagtaggcatccaaatttaacttgaagctccctgatggtcagggcaaaaagagtagcatggtgggtttaggcttgcagtatctatttttggtatttgtaatgccaaatgtattttttctttgctttgttttattttttaccagtcgaaactcttattgaggtaaattttacatgtcgtgaaatgtgcagatgttaaacagttagttggatgaggtttttttttttttttttgagatggagtctcactctgtcacccaggctggagtgcagtggcctgatatcagctcactgcaacctttgtctcccgggttcaagtgattctcttgcctcagcctcccaagtagctgggattacaggcatgtgccaccatgtccagctaatttttgtatttttagtagagacacggtttcaccatgttggccaggctggtctcgaacgcctgacctcatccgtctgcctccgcctcctgaagtgctgggattacaggcatgagccaccgcgcctggcagttggatgagttttgattaatacagaccttcatgtagccatcaatcgaatcaaaataacaaatgtctctatcaccctggcttaagtttgcctgttcttaaactttctgcaactggaagcctacagtagatgc

SEQ ID NO: 407514 - DNA, 453 bp, Homo sapiens
tctgttggctcgctgtggtttttccaatgccacaccagtgttttgcacatttaagatgctcagtgtgtatctatggaataaatgaatgagtgaaattatgtatagttttcttcttaattgtgatgctggattacctggacatccctacctctggtgactacaaatgaatcctcaggcaatgattgtgcaaggctagtgtctgccattgccagggcgtccccttagggtcaaatctatgaaccacactcctgaagcatatacttccagccagctgagcaaattctaactcaaggagagccatctagattaacccatttaaaaatccctttggaacaatgcatttactctgccaaagtcactactattataatgaaaaaatattcaatgtgtatttactttgcattttgtgacataatccatcaaacttaagtcacccacagcatatgaaaatat

SEQ ID NO: 407515 - DNA, 452 bp, Homo sapiens
tcccaacagttttggaagccaaggcaagaggattcccaggagttcaagaccagcctaggcaacttagcaagaccttgtatcttccaaaaactttaaaaattagttgtgtgtggtgtgcctggctgagatgagaggattgcttgaatccaggaggtggaggctgtagtgagctatgattgtggcacagcagtccagcctgggtgacacaaggataccctgtctttaaaaaaaacaaaacaaaacaaaacaaaaaaaacaactgaacactgcttaacatccaaaataagatccaggaactctcaatacttattatttatacaaacagcaataggtaaatttatgttctgctttgaacctatgaaaatttaaagaccgttgctttggcattgggcaagttattcttttatactatacttgtgatctaaacgttccaggtacttggaaattatttt

SEQ ID NO: 407516 - DNA, 576 bp, Homo sapiens
accctgtctccaccaaaaaatatgaaaaccagtcaggcgtggcggtgcgcgcctgcaatcccaggcactcggcaggctgaggcaggagaatcaggcagggaggttgcagtgagtcgagatggcagcagtacagtccagccttggctcggcatcagagggtttttttttttttctgtgaaggcatttgacataagacaatatacttctggaattattctaagaattaaaattagtgggcttttcctttagcttaagctgtgagtggtacaaaagttataaacaagtaaatgtgttactggcaaattaaggaaatgattttgtatattttctcttagcaggagttaggacatagcgagcagctaataatagcatcttactcatgaagagcttctccagtaagattaccacttgttatttacatatctatgcagaactgtcatctcttcctagttttgagaaagttacctttatattgttttattcgagcctgcgaccattaattaaggggtctttagaaaacattactgaaattgtaaagtacttatggcaatggaagctacggttaaatgcctgcgt

SEQ ID NO: 407517 - DNA, 410 bp, Homo sapiens
acctcgacaaggccaaggccaagaattgacctcctggagctcatcacgttctcaggttcagatgcctgggccccctacaccagaattaccaggggtgcttgtgaaaatgcagattcctgggcccaatcagctcttttgattcagaggctctggggatgaggtcctgcaatccacattttaaaccagcagccctggtgatgctgaggcatgcgtgcatttcagagctgtcagtatcagcgcaggaaagcacaacctctcacgcctgctgtcctcccgagcccagccccctcctactgtcaagaagagccttgatagcagtactatcggtgtgtgtgtgggggcgggggggggcggtgtgctgtgactcatttgtggctaatggtcattcagtaaactgggccgacaagaga

SEQ ID NO: 407518 - DNA, 596 bp, Homo sapiens
tggttacatgattaatttgatgtacagttaggctcactgatttcaatttgtattcaatattgaaatttacttttttcaacagtaagactactcttctttacagtagtggtactattcatatgaggtaaacactgtggccagttgtccatggactagaatttatatgtaaacagtagaatcggtatggtaacatttatatctacaacttaatatttattacaataaagtatttatgatcaatttttaagataactgcctatggctcccgaaaagactatagctaaggatcttcaaaagttagtctgattaactttagttgacacttacatagtgctatgtgccaagcactgtaagtgttttatatacatgaaacagacctctgaggtatgttgcccaaaatcatgctgctagtaagctgaacagatagaattttttttttttttttagacagagtcttgttccattgcccaggctggagtacagtggcacaatcatatctcactgcagccttgaactcctaggctcaagcgatccttctgcctcagcctcccgagtagctaggactacaggcacacatcatcatgactagcaattaa

SEQ ID NO: 407519 - DNA, 460 bp, Homo sapiens
  misc_feature (456)..(456): n is a, c, g, or t
  misc_feature (459)..(460): n is a, c, g, or t
acaacatgaaggatggaaggtaaagggatcttggaagaatttctacatcacatttaaagtggcaaatattgattcaaagcatgctgagaaagtttaagtttgtttactgtaacagtcatcaccacacacatacacacacacacacacacacacacacagcccaaagtgaaataataagaaactaaaatagaatactaacaaatgctcaagtaacccaaaagaagaagaaaaaaagggtaacagaggaaggaaaaacataaggagtgatgagtaaacagataattaaatagtagccctaaacccaaacatatcaatattaacattaaatgtaaatggtgtaagcacactagttaaaatagagataatcagaatgagtaaaaaggtatcactcgactatatgctgtctaccagaaacatacttcaagtataaagatataggaaggttaaatgaaaaanaann

SEQ ID NO: 407520 - DNA, 4095 bp, Homo sapiens
ctgcatttataccacttctcaattggcatagatacatgttggctttccctatgggttttaatcaaatattgagattggaaattttctttgaaatatttcctttcagtagcttacttttaagtactgtcgaatattaggatgattgagaagcacatcttgttttggcctctcttctaggggcttcggtggatggagaaaacaagccaaggccatcattgtattctctgcaaaattttgaggagatggaaacagaagattgtgagaagatgagcaatatgggaactttgaactcttccatgctgcacaggagtgcagagtccttaaagagtctaagttcagagttgtgtccagagaaaatcctgcctgaagagaagccagtacatctgccagtgctcagaaggtccaagtctcaatccagaccccagcaggtcaagttttctgatgatgtcattgacaatgggaactatgacattgaaatccggcagcctccgatgagtgaaaggactcggagacgcgtctacaattttgaagagaggggatccaggtctcatcaccaccgccgccggagaagtagaaagtcccgctccgacaatgccctgaatcttgttacagaaagaaaatactctcccaaggacagactgcggctgtacacccccgataactatgagaaatttatacagaataaaagtgcccgggagatccaagcatacatccagaatgctgatctctacggacagtacgcccatgccacttccgattatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagcttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgctttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattgaaaaaaaaaacaaaaaacattgctatttataacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactttaagttaatatgaggttctggttcaaggaaaacttacgttggatctgaaccaatgagcagatattttgatatgtgccactcttgcatatacatctcagtcctaactaaagattctagtggcatccaggacctttagggaggcatttaataaacacttaataaataacaaaactacctttctgaatataaatctttgcaaatgtatccagataacttccattttgtgcctgtgttcaggcatgatttattttgcagttgccctaccattaacagacctccatttgtctcgtgtgtccacacgccccacttgtaggccagaaatagggcttcagacacagaggcttattttttccatatagactggagtggggaaaatttggccttagggaggacagacacaagtccaatgggtaaaccagcgagtagtaggtggacagccgtcccacacaagggtttgtatctgggctacacagattcccttcagaaaagcaccaatggtgagagagttcttcactcagtaacttacattccctggtctggtgcctttaaaaaaccatcagcaatgaaaaggaagtgcatacacatgacaaaaaaattcaaatagggcaaaagtcagagacagcatctcctttccattcttcatcccagtaccccaggtcctctccccagaagtaaccactcttacccagttttagtgtctccttcagacattcaaagcacattcgtataaatgtgtcttttaaaagtggtagtgacctatatgtgctgtgacatgcttttttccctttgtatgtggacatttcacgttagtgtatataggtctacccattctttcagtgactgcttgatagcctactcctaatgatggagttgactttcctcatacattgtgctacactggcacatgtgcacataaatcgggagcagcgtagttactgggacaaaggttacgtatttaagactgatggatattgccaattttcctccaaaagaaattctcctgatttacattaatgtaatgtaaatgagagtgtttgttccatcacaacctctcaatgtattagcagatttcttgattttgaagaaattttcagaacctgtgctgccacaagtgggcatccttttagaaaagactgttgcaatatgttgcttataaaggatggataataaatagtaaacaggtgatacttagcctgaagaaatgcaggtataaggtgaaggtactgccctcacttttcaagtacattctcaaaagataggggtaacatagcctgccaaaggcttaaggaaatgcagatatttattcacaataataatgtaactttcttttccttttttttttttttttgagatggagtttcgctcctgttgcccaggctggagcgcaacggcacaatctcagttcactgcaacctctgcctcccgggttcaagcaattctcctgtctcagcctccggagtagctgagattacaggtgcctgccaccatgctcggctaattttttatatttttagtagagacagtgtttcaccaagttggccaggctggtctcgaactcctgaccttcaggtgatccacctgcctcagcctcccaaagtgcaggggattacaggcatgagccactgcgtctggcaataatgtaactttgaagcttaaaaattaatcccagtttgtagcaataacagaagactatctacaacggaagaaagaagcaactgccttacagttctgtaaagaattggcaagaaaataaagcctatagttgccgacttagtctat

SEQ ID NO: 407521 - DNA, 2555 bp, Homo sapiens
aatttcggcacgagggattttgttctaggttaattaccgataaacgaacgagactctggcatgctaacttagtatttcatagacttaagtgtattcctaatttaacggtgcaaatattaatgtatatactgtacagttcagattttaaagctgatatttttatatccctgaattgtaagccgtttgttacgctgcagtgctagatttgccagggaaccagaatttatggatgaactgattgcttatattttagtcagggtttataaatgtagatggtcaaatttacattgcctagtgatggaaaattcaactttttttgatttttttttccaatattaaaaaaggctctgtatgcatggtggggctatgtaagtactctttaaaactatggccctattaatcttacaagtgttacttatgggtcaagcaatgtaaactgtataaatgtaaaaacaacccctccacacacataacccctggaatatatggtaaaaacaagtagaagctgtttcagcgagtgggttttttccccctgcctgcggggggtgcctttctcattttcagcaaggtgatgattatctcatgggaaatgacaaagatctgcttttgtggcagaggactttgtagatttgttattttaagagaggttattcctttttattccttccctcccactaatttgttggcctttaacagcaattttgaaaactgggtcttctggttatgtttttgttttaaaatctttaaattagaggatgctgtgccattgagtactttaagttaatatgaggttctggttcaaggaaaacttacgttggatctgaaccaatgagcagatattttgatatgtgccactcttgcatatacatctcagtcctaactaaagattctagtggcatccaggacctttagggaggcatttaataaacacttaataaataacaaaactacctttctgaatataaatctttgcaaatgtatccagataacttccattttgtgcctgtgttcaggcatgatttattttgcagttgccctaccattaacagacctccatttgtctcgtgtgtccacacgccccacttgtaggccagaaatagggcttcagacacagaggcttattttttccatatagactggagtggggaaaatttggccttagggaggacagacacaagtccaatgggtaaaccagcgagtagtaggtggacagccgtcccacacaagggtttgtatctgggctacacagattcccttcagaaaagcaccaatggtgagagagttcttcactcagtaacttacattccctggtctggtgcctttaaaaaaccatcagcaatgaaaaggaagtgcatacacatgacaaaaaaattcaaatagggcaaaagtcagagacagcatctcctttccattcttcatcccagtaccccaggtcctctccccagaagtaaccactcttacccagttttagtgtctccttcagacattcaaagcacattcgtataaatgtgtcttttaaaagtggtagtgacctatatgtgctgtgacatgcttttttccctttgtatgtggacatttcacgttagtgtatataggtctacccattctttcagtgactgcttgatagcctactcctaatgatggagttgactttcctcatacattgtgctacactggcacatgtgcacataaatcgggagcagcgtagttactgggacaaaggttacgtatttaagactgatggatattgccaattttcctccaaaagaaattctcctgatttacattaatgtaatgtaaatgagagtgtttgttccatcacaacctctcaatgtattagcagatttcttgattttgaagaaattttcagaacctgtgctgccacaagtgggcatccttttagaaaagactgttgcaatatgttgcttataaaggatggataataaatagtaaacaggtgatacttagcctgaagaaatgcaggtataaggtgaaggtactgccctcacttttcaagtacattctcaaaagataggggtaacatagcctgccaaaggcttaaggaaatgcagatatttattcacaataataatgtaactttcttttccttttttttttttttttgagatggagtttcgctcctgttgcccaggctggagcgcaacggcacaatctcagttcactgcaacctctgcctcccgggttcaagcaattctcctgtctcagcctccggagtagctgagattacaggtgcctgccaccatgctcggctaattttttatatttttagtagagacagtgtttcaccaagttggccaggctggtctcgaactcctgaccttcaggtgatccacctgcctcagcctcccaaagtgcaggggattacaggcatgagccactgcgtctggcaataatgtaactttgaagcttaaaaattaatcccagtttgtagcaataacagaagactatctacaacggaagaaagaagcaactgccttacagttctgtaaagaattggcaagaaaataaagcctatagttgccgacttagtctat

SEQ ID NO: 407522 - DNA, 2859 bp, Homo sapiens
  misc_feature (1927)..(1927): n is a, c, g, or t
  misc_feature (2858)..(2858): n is a, c, g, or t
acccacgcgtctggccgcgggccgcctctgcggcagcgctagtcgccttctccgaatcggctccgcacagctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagtatggtattgtgctggatgccgggtcttcaagaaccacagtctacgtgtatcaatggccagcagaaaaagagaataataccggagtggtcagtcaaaccttcaaatgtagtgtgaaaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggcttttgcaggattctactacacagccagtgctttaaatctttcaggtagcttttccctggacaccttcaactccagcacctggaatttctgctcacagaattggagtcagctcccactgctgctccccaaatttgatgaggtatatgcccgctcttactgcttctcagccaactacatctaccacttgtttgtgaacggttacaaattcacagaggagacttggccccaaatacactttgaaaaagaagtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtggcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttcttcagagacctcactacccacatgctgatctattggggaacagagaagagacaggccacnaaggtcaggctctttatattaagttccccagaggaagagtaagttgagaaggtatcagtttaatgttgaagaattgacctcagggctcagtttccatttccctccctcagtattcttcctggcaagatacccattaagcatttcgccaatcagaatctcattttatagtttttcccattggtctttaactaagactttcttgtagcaatctcgtaagcagtgaaccccctcagatcagtagaatatagtatctgggggagaagacttacttccttcagggcagcagccacagccaggcttctgtcatacaggtagatcccgaagcacagagacataaaaaaggtctcccagaaaactatagaccattctccaagtggaattcccacttagggctctggtcactagattgcaacctgtgtgtttgtcatcatcctcatctcaccattgtattgctatgccctcccataaaaacacattgatccctagcaagattattgcattccagattttactgcctttgctaggcttttgcttagcaaagggctgactttccattgttatcatggtgtatatatttttgtcaccattcccacaagtatacttgatgttgtcatagaacgaacatcctactctatgatttactaaccaattactttcccagatcatagacctctctgcatagtagtcataggtcttgactttggggaaagaaaaggaagctgcaggaatatttatctccaaagtcgaatgagaaagaactccagcaaatccaatggctacaaactaaaaatcagcattatttcatattgctgtttcttagctgaatatggaataaagaactattattttattttgacttgcaaaaaaatcactggccgccgtttacaacgtcgtgactgggccctgcggtacccaactttcgccttgcagnc

SEQ ID NO: 407523 - DNA, 2790 bp, Homo sapiens
  misc_feature (1927)..(1927): n is a, c, g, or t
acccacgcgtctggccgcgggccgcctctgcggcagcgctagtcgccttctccgaatcggctccgcacagctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagtatggtattgtgctggatgccgggtcttcaagaaccacagtctacgtgtatcaatggccagcagaaaaagagaataataccggagtggtcagtcaaaccttcaaatgtagtgtgaaaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggcttttgcaggattctactacacagccagtgctttaaatctttcaggtagcttttccctggacaccttcaactccagcacctggaatttctgctcacagaattggagtcagctcccactgctgctccccaaatttgatgaggtatatgcccgctcttactgcttctcagccaactacatctaccacttgtttgtgaacggttacaaattcacagaggagacttggccccaaatacactttgaaaaagaagtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtggcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttcttcagagacctcactacccacatgctgatctattggggaacagagaagagacaggccacnaaggtcaggctctttatattaagttccccagaggaagagtaagttgagaaggtatcagtttaatgttgaagaattgacctcagggctcagtttccatttccctccctcagtattcttcctggcaagatacccattaagcatttcgccaatcagaatctcattttatagtttttcccattggtctttaactaagactttcttgtagcaatctcgtaagcagtgaaccccctcagatcagtagaatatagtatctgggggagaagacttacttccttcagggcagcagccacagccaggcttctgtcatacaggtagatcccgaagcacagagacataaaaaaggtctcccagaaaactatagaccattctccaagtggaattcccacttagggctctggtcactagattgcaacctgtgtgtttgtcatcatcctcatctcaccattgtattgctatgccctcccataaaaacacattgatccctagcaagattattgcattccagattttactgcctttgctaggcttttgcttagcaaagggctgactttccattgttatcatggtgtatatatttttgtcaccattcccacaagtatacttgatgttgtcatagaacgaacatcctactctatgatttactaaccaattactttcccagatcatagacctctctgcatagtagtcataggtcttgactttggggaaagaaaaggaagctgcaggaatatttatctccaaagtcgaatgagaaagaactccagcaaatccaatggctacaaactaaaaatcagcattatttcatattgctgtttcttagctgaatatggaataaagaactattattttattttgacttgcaa

SEQ ID NO: 407524 - DNA, 243 bp, Homo sapiens
gcagacattataactcagtactcttaatactttaatgtacatctctaagaataagacattttcctaatgtaattgtgtgatcacaatacagtgaccacacttttaaaacttaaaaaaattccaaatatcagtttgttttattggtaaatattttagtgtgccagacattaagtcctctttgttgttgttgaaacataaacaaaatactgtttttttaatgctttcaaagaggaaggcattgca

SEQ ID NO: 407525 - DNA, 389 bp, Homo sapiens
ggaatgtggcaaaggccacttattagctctccctctttctgctccctttaccttctgcctcagaaagatcattttcatttaagcagcagtagctagaaggggagccccttcttatcatagagcatggctcaggatgaggaatccctggcacaggaggctgggtggtgtggtggaaagagacccaggttgggaggaagaaagggctgtgcagactcccaaacactaccaaaaggtgaggcatcgtctccggtttgagcaagttgctggggccctcctcctgtttaccactctgtgaacttatcctgctgattccgtggtgtctggggcaggtcctgactctgggaccaccccgcaagccttcacctggtgactttgtgatctgggagctt

SEQ ID NO: 407526 - DNA, 158 bp, Homo sapiens
ctggaatcagttgattccttttatctataattacagtgagcaacataatttttaatattaaactaacaagtactgggaaaacctgtttctactttctgtggtttgcttatcaaattaatcctacaattttgatcccgttatacagttctcaaggtaca

SEQ ID NO: 407527 - DNA, 1429 bp, Homo sapiens
  misc_feature (1251)..(1251): n is a, c, g, or t
ggacactgggcccgtattaggggaacatctgtcataggttctactgcgatagactcctagcccctctcctgtgacctgtccctgtctgccctgggcgggagccacgcagactcatagcaaccaccccaagctgaagctgtgacgcagagcccggtacccatccttgtggaccctggctgaggtggagggtgtgctctagcagaaccctggccagactccagacagtattcttcccctccaccctactccatcctgtcccccctactccatcctgtccccccactcaccaaaggacttgggccacttctcccaccttgcctgcctcaacctaactcctcctttcatttaagctcagggttaaccagatactcttagatataagtctacatcccccaaaataggatcctcaccccccatgcacatacacacacattcctgtccaagaaagcccacaggtggctgctctgcctgtgtgtccacttgtgtatgtacatgccccagccacaaggcacgggtgacgcccaagaagagcccctaagatgtaagatacaagtatataatttatatgtatgcagagacaaactgattgaaacatttctagcactgtttattctcctacatcccctctttttgacctgaaaggtcctttattgtctttggatctgccaaacctccctgtgagggtgtggttcaggcatccagccagaggtccccccacttcttcgatgtccatgcccactcaggcactttctcatataccactgtgccacttcaagtgtgacgtatttaggttctttggggtttcttccatctcatcccacccactcatttttgttccttgttttgttcagacacttccccagcctgggtccaactgctgagctggatagttttctctgcagcttcctgctgaagatttaactcagccatggccttctccacacctccctgatgggtgtctctctacctgggttgtaattagaactgggatctatttaatttctccagccatttcccaacccttcccacagtactagaaatcttagtcctataccagagtaagaggtgtgtacaagcccccactgtactgtatgcacggatcgcttggccaataattatgtcagtgaatctgagacttgtattaaacactttagacatttgtagaagggaattcgtagactttttcacttacatacgaaaggtttttttttttttttgtgcagttctcattgcaaaaataaacatttgtcntggtgtaacggttaaaaaaaaaaagggggggcggcaaaaaatacccaagggggcgaaggtacggttccccgatttttgttgaaaggggccacatcagggcgtgtttaaaaaaagcagggagggtgaaagtggatggagaagcacaggatttgagagccacctggggggttgggaaact

SEQ ID NO: 407528 - DNA, 699 bp, Homo sapiens
agctacaggtgtggaaggcatgaaaaggcaagatctgtcaggacattgcgaatcagtaaaaccagacctttgctcttgagagactcccacacgtgaaggttcttaataaactttctcacctgccagaaagtgtgaaagccttgaatgtggaccccttttgatatgcctggcattgttgcattgagttttgtcatccgtttctagaaaagataaagcaagcttattttataacttcttttcttgtttttacttactatgtcttcatcttcattaacgacaacaaccaagagtgccagaattctcttgtagcactaacccccttctctgcctccttgtctccctccgtgaaaaggcaacaggcatctgtttctttaagggccacagatctccttactgtttgtgccataactaagagttgcttgtgtgtctccacggaattccccccaccccgattgctttacataaatgtccaattaatgctagttaaaagttcttgttcatgatctgtctgaagggagagacaaagaagggaagcggagatggccccgctgctgtggccatgtcctacttctgtgatgcattaccagcaacttctttccacatgtttttgcattgtttcttcttacatttatcctctgactattgtttccttttgttccagcaacagctggaaatggtaaatttgtgttttgagccaaa

SEQ ID NO: 407529 - DNA, 1895 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatga

SEQ ID NO: 407530 - DNA, 846 bp, Homo sapiens
acgacgatatgtaattatcatgaattattttattaatgtaaaaacctaagaaccgacaaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatga

SEQ ID NO: 407531 - DNA, 1029 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgtcccagggggcaaatttctctcgcgttaaccggatctggcatgggtcctctatggtgatccttttgtctggattggagaataccagtgcaataatatgacttgtgcaagctggtttagctacggccactgagactcggggccaatgttgcagtgcgtgataccacatagaggcaacatgaaagccacgaaaccctgactccgcgacactgtttttttttattatatataatattattcattatgtaggacgcattcgcattattacgcactatgccatagatatcacccct

SEQ ID NO: 407532 - DNA, 512 bp, Homo sapiens
  misc_feature (31)..(31): n is a, c, g, or t
  misc_feature (40)..(40): n is a, c, g, or t
  misc_feature (55)..(55): n is a, c, g, or t
taacgcaccataatatccccaataaaaaacnaaagaccantcttgagagccacanaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacag

SEQ ID NO: 407533 - DNA, 517 bp, Homo sapiens
aatgcctgattgctcggaccatatggaggcctaactttggtaggaacccacctgcaacattgtctcctgaaatgaaacacaactgtttgtttaatggaactgacctgttctccaggagtaagagattttcagtaagataagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgt

SEQ ID NO: 407534 - DNA, 431 bp, Homo sapiens
  misc_feature (54)..(54): n is a, c, g, or t
acataatttctacgttgtcaaaataatgggtggaccgccacagctacaaccganaaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgt

SEQ ID NO: 407535 - DNA, 495 bp, Homo sapiens
  misc_feature (54)..(54): n is a, c, g, or t
acataatttctacgttgtcaaaataatgggtggaccgccacagctacaaccganaaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtgcctgaaaagacctcatcgccgtaactctgttgtcatttgcattatatgagggtgagaacacga

SEQ ID NO: 407536 - DNA, 4608 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaa

SEQ ID NO: 407537 - DNA, 4661 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgagatggagatttggaggcacagaaaagttaaagaactttcctgtttatacacctagatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaa

SEQ ID NO: 407538 - DNA, 1739 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagt

SEQ ID NO: 407539 - DNA, 3559 bp, Homo sapiens
acgacgatatgtaattatcatgaattattttattaatgtaaaaacctaagaaccgacaaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaa

SEQ ID NO: 407540 - DNA, 1564 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacag

SEQ ID NO: 407541 - DNA, 3632 bp, Homo sapiens
tacctatgcatctccctcctccacccctacaacaaataactcgttactataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaa

SEQ ID NO: 407542 - DNA, 3556 bp, Homo sapiens
  misc_feature (31)..(31): n is a, c, g, or t
  misc_feature (40)..(40): n is a, c, g, or t
  misc_feature (55)..(55): n is a, c, g, or t
taacgcaccataatatccccaataaaaaacnaaagaccantcttgagagccacanaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaa

SEQ ID NO: 407543 - DNA, 3554 bp, Homo sapiens
  misc_feature (46)..(46): n is a, c, g, or t
ggggccgccaccagctgcgtcgcgaacgggagataagaacccttangaccacgaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaa

SEQ ID NO: 407544 - DNA, 3642 bp, Homo sapiens
aatgcctgattgctcggaccatatggaggcctaactttggtaggaacccacctgcaacattgtctcctgaaatgaaacacaactgtttgtttaatggaactgacctgttctccaggagtaagagattttcagtaagataagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaa

SEQ ID NO: 407545 - DNA, 349 bp, Homo sapiens
tcatcttgggcctgtgttatcagtacatttttaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcactctcggtatgtgcattttcccca

SEQ ID NO: 407546 - DNA, 4812 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaaaaaaagaaaacaaatccccacaccatcgaccagcaccaaaagaggaaacagcagtcgccagacaatcacgaccaaacacaaaacacacagaggggggcgcgcggcccaagagagaattaccacaagtgggggcggggggaccaaacaaaaagacaacacgtcccaaaccggcgcacggggggcccaaaacgcgggcgggctcat

SEQ ID NO: 407547 - DNA, 4472 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagtatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaa

SEQ ID NO: 407548 - DNA, 1483 bp, Homo sapiens
cgcagcgtaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagagttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgt

SEQ ID NO: 407549 - DNA, 178 bp, Homo sapiens
  misc_feature (13)..(13): n is a, c, g, or t
ccacgcgtccgcnccacgcgtccggggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaa

SEQ ID NO: 407550 - DNA, 1744 bp, Homo sapiens
  misc_feature (7)..(8): n is a, c, g, or t
  misc_feature (27)..(27): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaa

SEQ ID NO: 407551 - DNA, 1702 bp, Homo sapiens
gctggtaccggcccgggatgttagggatcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaa

SEQ ID NO: 407552 - DNA, 1597 bp, Homo sapiens
  misc_feature (7)..(8): n is a, c, g, or t
  misc_feature (27)..(27): n is a, c, g, or t
  misc_feature (1522)..(1522): n is a, c, g, or t
  misc_feature (1524)..(1524): n is a, c, g, or t
  misc_feature (1565)..(1565): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagngnggggggggtggagagggagcccgggggaggcgtctgcgggnggggaggagggtaatgagcgtgggagggtggg

SEQ ID NO: 407553 - DNA, 1597 bp, Homo sapiens
  misc_feature (7)..(8): n is a, c, g, or t
  misc_feature (27)..(27): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtgggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaa

SEQ ID NO: 407554 - DNA, 1340 bp, Homo sapiens
  misc_feature (7)..(8): n is a, c, g, or t
  misc_feature (27)..(27): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggtggtccgagcgaccgagatcctgagagtcgac

SEQ ID NO: 407555 - DNA, 1073 bp, Homo sapiens
cgcccgtgttgcgctcccgccggtgttgcgctcccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaa

SEQ ID NO: 407556 - DNA, 908 bp, Homo sapiens
  misc_feature (7)..(8): n is a, c, g, or t
  misc_feature (27)..(27): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgtgtaattattattattttctacaataaatgggacctgtgcacaggaaaa

SEQ ID NO: 407557 - DNA, 505 bp, Homo sapiens
gctggtaccggcccgggatgttagggatcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaa

SEQ ID NO: 407558 - DNA, 321 bp, Homo sapiens
ctctgctgtcctcaagctactgtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaa

SEQ ID NO: 407559 - DNA, 472 bp, Homo sapiens
gctggtaccggcccgggatgttagggatcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaa

SEQ ID NO: 407560 - DNA, 1619 bp, Homo sapiens
  misc_feature (7)..(8): n is a, c, g, or t
  misc_feature (27)..(27): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggggagtgtcttcatttctcaacacattgattccccaccatttgcggattcggaaaaaaaaccgaatcctactgtttagagaaatgtttttcttcctacatatacatacccattgctccctggaacttataccggttgtccacagtggtacaatccaaattgtgttacccttagtg

SEQ ID NO: 407561 - DNA, 1221 bp, Homo sapiens
  misc_feature (7)..(8): n is a, c, g, or t
  misc_feature (27)..(27): n is a, c, g, or t
  misc_feature (1194)..(1194): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtgaatccagtgtcgcactgcatcccccgagcctcantacacctccgtctgcatacccacaacc

SEQ ID NO: 407562 - DNA, 583 bp, Homo sapiens
  misc_feature (7)..(8): n is a, c, g, or t
  misc_feature (27)..(27): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgcctctcggccgtgctgctgtccggaggtgggggccagcctacacactgcctg

SEQ ID NO: 407563 - DNA, 472 bp, Homo sapiens
  misc_feature (7)..(8): n is a, c, g, or t
  misc_feature (27)..(27): n is a, c, g, or t
aaaccannctccgctaatgcaactcantatcgtgacacgttggcctacttgagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtgagtctggaaagctaacgtgagcggaccgctatgggttttgtctttttttc

SEQ ID NO: 407564 - DNA, 3251 bp, Homo sapiens
tgagtgacctcgcgggtgggcggggcctgggggtccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407565 - DNA, 3176 bp, Homo sapiens
tgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407566 - DNA, 3564 bp, Homo sapiens
  misc_feature (15)..(15): n is a, c, g, or t
  misc_feature (37)..(37): n is a, c, g, or t
cgcggccgcgcgatnacggctgcgagaagacgacagnaaggtgagaaccctccagcccagggcaactgcctataatgtatgttcacatgtgctatctcctttggtcaataccacacactacaggtgaggaaactgagtctctgctgggacactgggtcaggaagcaggcagttaaggtcacctgtgcacagtggcagcacagggggacagccttctaggtagccagcctggcctgagggttctgtcacttttacctcccactcagtgttgtttctctttctttcccctccttttaagatccctccaggcccaggatctggggacaacgctggtggggagtgatctgggtgtctgtgcaggaaaccgctgcactgggtgagatgggcatgggagactgtgcctggctgaccagagacctcgttttcttccagaacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407567 - DNA, 3097 bp, Homo sapiens
tgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagagtccggagtgctcaccaggtgccaggtctgtgggagctgatttctacccaccatgaaattgaattttcccaacccccacaagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407568 - DNA, 3376 bp, Homo sapiens
  misc_feature (15)..(15): n is a, c, g, or t
  misc_feature (37)..(37): n is a, c, g, or t
cgcggccgcgcgatnacggctgcgagaagacgacagnaaggtgagaaccctccagcccagggcaactgcctataatgtatgttcacatgtgctatctcctttggtcaataccacacactacaggtgaggaaactgagtctctgctgggacactgggtcaggaagcaggcagttaaggtcacctgtgcacagtggcagcacagggggacagccttctaggtagccagcctggcctgagggttctgtcacttttacctcccactcagtgttgtttctctttctttcccctccttttaagatccctccaggcccaggatctggggacaacgctggtggggagtgatctgggtgtctgtgcaggaaaccgctgcactgggtgagatgggcatgggagactgtgcctggctgaccagagacctcgttttcttccagaacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcaggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407569 - DNA, 3267 bp, Homo sapiens
tgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaagttggaccaatctgacactcctccagcactgccggagagagcctgttttgcggggatggtgcggggagaagcccacctatcccgaacagagggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407570 - DNA, 1890 bp, Homo sapiens
agccttttgactaaatgaccttgggtgaattatggaccctcttagagcctcacctgtcaatagggaataagaattcttaggccccaggtggttattgcagcatcggctccgatgcaagaagaagcactttgtctgaagaggacacgcaaggaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407571 - DNA, 1943 bp, Homo sapiens
agccttttgactaaatgaccttgggtgaattatggaccctcttagagcctcacctgtcaatagggaataagaattcttaggccccaggtggttattgcagcatcggctccgatgcaagaagaagcactttgtctgaagaggacacgcaaggaactacaggatctcatgcacatctcacgggcccggaagccagcgttcatcctgggctccatgagggacgagaagcggacatgcagaacctgagcccctgagaggtgaagtgacttgctcaaggtcacacggaccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407572 - DNA, 1551 bp, Homo sapiens
gtggggtggtgggtgggagtcgtgcacttgccatcaggcaccctcaccgtgccaccagcccacccgctgcactggtctttattggctgaggacagggattgcgggggagctgtcaggcccctggcaggttagaaaagtccctggaaagtcctcagctgtacctgccttccaccaggacgaactagccagagagtgtggcttcgtgggtcctgcttctgaagagttcccagcctcccctcttcccgcacccccagcccccaacacgcacaccctgagatctggagtgcatgggttttatgccagtcccttgtgccactgggccgccctccttccccgcccctagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407573 - DNA, 1526 bp, Homo sapiens
  misc_feature (1478)..(1478): n is a, c, g, or t
  misc_feature (1493)..(1493): n is a, c, g, or t
  misc_feature (1506)..(1506): n is a, c, g, or t
tgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagagcccttaaaccaacccttaaggcaggtcaacccccaaaancccaagggccccggnattgggttggggncccttggggggtttgcccgg

SEQ ID NO: 407574 - DNA, 326 bp, Homo sapiens
ctaatttttgtatttttagtagaggcagggtttcgccatgttggccaggctggtctcgaatttctgacctcaaatgatccgcccgcctcagcctctcgaagtgctgggattacatgcctgagccactgtgtctggtccatactagcctctttgagtgctgaaaggttatctctgtaacttatttagtgagaaccctccagcccagggcaactgcctataatgtatgttcacatgtgctatctcctttggtcaataccacacactacaggtgaggaaactgagtctctgctgggacactgggtcaggaagcaggcagttaaggtcac

SEQ ID NO: 407575 - DNA, 390 bp, Homo sapiens
gcaacaggtttttccattggattagcctttcaaaaaaaccaacttttgctgaattgtgcccccaaggttggaccaatctgacactcctccagcactgccggagagagcctgttttgcggggatggtgcggggagaagcccacctatcccgaacagaggttggagtgggcactctgctacccaaggccctggggtgtgaattgtggggaaagggaaaggtggatgggcgggtggctcagccgtcctcctgcctcatttctctccagggtgatgctgacagggacactgtctgaccggcagccggctgaactccacctcttccggaactacgatgctccagaaactgtccgggagcctcgtttcaaccagaacgttaacctcaggcctccag

SEQ ID NO: 407576 - DNA, 1277 bp, Homo sapiens
gcagggcgggcttcctgcaggcggcagagaccgtcagactgtcagacactagccagtctaactctcctattgcgtgcggatggggagcctgggacccagagtgggaggcatcacccaagatcatccagcaaatcggcagcagagcttgttcggaagcaaataagagaggcagcggccgggcgcagcggctcacgcctgtaatcccagcactttgggaggccgagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407577 - DNA, 922 bp, Homo sapiens
gtggggtggtgggtgggagtcgtgcacttgccatcaggcaccctcaccgtgccaccagcccacccgctgcactggtctttattggctgaggacagggattgcgggggagctgtcaggcccctggcaggttagaaaagtccctggaaagtcctcagctgtacctgccttccaccaggacgaactagccagagagtgtggcttcgtgggtcctgcttctgaagagttcccagcctcccctcttcccgcacccccagcccccaacacgcacaccctgagatctggagtgcatgggttttatgccagtcccttgtgccactgggccgccctccttccccgcccctagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaaccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407578 - DNA, 3014 bp, Homo sapiens
tgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407579 - DNA, 3222 bp, Homo sapiens
aagaactaggatgagttgcttgaggtcacaccgatgaggttgaagctggaatctgacaccagagcctgtgtgattgtcctgatgtgtaagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407580 - DNA, 2770 bp, Homo sapiens
accaccgcaccccagcctgggttacagagcaagaccttgtctctaaaaaacaaaactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407581 - DNA, 3215 bp, Homo sapiens
tgagtgacctcgcgggtgggcggggcctgggggtccgttccccaacttcctcggcgctccggactcccaagtctccgccggaccctcctttggatattcctcgtgtctccgattctgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgatcacatgcccagtagttaactgttaatcaacgcactctctgtggaacaacaggctggtcccgttgagccaacactctctgggcactgccttcactagactctggctggctgctgcgcttgtagagactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407582 - DNA, 3320 bp, Homo sapiens
tgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacatgcagaacctgagcccctgagaggtgaagtgacttgctcaaggtcacacggaccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaagttggaccaatctgacactcctccagcactgccggagagagcctgttttgcggggatggtgcggggagaagcccacctatcccgaacagagggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407583 - DNA, 2761 bp, Homo sapiens
aagaactaggatgagttgcttgaggtcacaccgatgaggttgaagctggaatctgacaccagagcctgtgtgattgtcctgatgtgtaagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccccatcagctcaaacattaagggtacccgggcacaaccgtacccctgcccccagccccagcctccctgagggcctgccgggctgcctctgccccagcccccagcaagggcactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407584 - DNA, 2547 bp, Homo sapiens
tgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctccagctcagccctcagaccagctggtgtggcgggcggcccgaagcagcggggcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaaccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattcaagttca

SEQ ID NO: 407585 - DNA, 1553 bp, Homo sapiens
tgtttgcggaagtaggaggaagtagaagtgctgagtaagccgagacagagggggaagacggtggggcctccccacctgccccgcagaagatgcagttctttggccgcctggtcaataccttcagtggcgtcaccaacttgttctctaacccattccgggtgaaggaggtggctgtggccgactacacctcgagtgaccgagttcgggaggaagggcagctgattctgttccagaacactcccaaccgcacctgggactgcgtcctggtcaaccccaggaactcacagagtggattccgactcttccagctggagttggaggctgacgccctagtgaatttccatcagtattcttcccagctgctacccttctatgagagctcccctcaggtcctgcacactgaggtcctgcagcacctgaccgacctcatccgtaaccaccccagctggtcagtggcccacctggctgtggagctagggatccgcgagtgcttccatcacagccgtatcatcagctgtgccaattgcgcggagaacgaggagggctgcacacccctgcacctggcctgccgcaagggtgatggggagatcctggtggagctggtgcagtactgccacactcagatggatgtcaccgactacaagggagagaccgtcttccattatgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgctgagaaccgtgggggccgaatactgcttcccacccatccacggggtccccgcggagcagggctctgcagcgccacatcatcccttctccctggaaagagctcagcccccaccgatcagcctaaacaacctagcaacctaggtaggcctcgcctcccgactccctcttctccagctggttcccaggcccctggatcacagcaggccccaccaaagcaacaggatccctaggacggaagtcactaaagga

SEQ ID NO: 407586 - DNA, 292 bp, Homo sapiens
gtttgtttatttaaataaggaatgaatgttgccttgaatctcaaaaatgataacttatttccagtctggtaggcagagtaaaataagtcacatgtttttgaatttcaactgagagtttcattctgttttgaatttttaaacatgaccttcagagagtgaaaagttcaaacaaattcatttaatctcagcccaacagttagatattaatatacctccaataattttactaatactaatcctgtgtatttctttgtaaaaagaaataaacttctttatatatatacgtgtattt

SEQ ID NO: 407587 - DNA, 1795 bp, Homo sapiens
  misc_feature (1456)..(1456): n is a, c, g, or t
cccaggccccacaatgcacttcggggcgcgtcactcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatntcagattatttgcacatttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcagactatagccgttgtttcccaaacttcagtctctttagtactacttgtattattttcttaatatttatcttttaaattttaaagtttttttaaaaaaa

SEQ ID NO: 407588 - DNA, 1455 bp, Homo sapiens
cccaggccccacaatgcacttcggggcgcgtcactcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaat

SEQ ID NO: 407589 - DNA, 760 bp, Homo sapiens
cccaggccccacaatgcacttcggggcgcgtcactcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctggaacttttgcagagtctccataaaccattggtacattttcagaaacatttaattttgttatcaacatgccatccttgggttcaagaagactaaagaaaagactttataggagaaggcaataataacaaaagcaaaacaa

SEQ ID NO: 407590 - DNA, 387 bp, Homo sapiens
  misc_feature (44)..(44): n is a, c, g, or t
aaaaaaaaaaaaaaaaaaaaaaaaaaaaagcggccgcccgaatnggggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaagtaagacttcagtttgcttcatttgactcatttgcccagtagttgtcattttaatgaagtttaagtggttgcaatagaaaggagtgattaggaaaacctgttcaagtcgagcatc

SEQ ID NO: 407591 - DNA, 1345 bp, Homo sapiens
cccaggccccacaatgcacttcggggcgcgtcactcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccaggtaggttttcttccattttaaagaaacacttaccattattgtttacttcgggtatcagttctaacaattgtgcattttaaataaattattaaaactctgagttctttgcttctcttttaatttgagcctcttttaactttgtgacctatgtctccattttgagtagacatacatcccagtgaacctgatgttaaccttcttcctgtgctgaggcttcagtggtggtatgtcatctgcctatggtagtaaagactacttctaggctgggtgtggtggctcatgcctgtaatcccagcactttaggaggccgaggtgggcagatcacttgaggtcaggagttcaaggccagctggccaacacggtgaaaccttgtctgtactaaaaatacaaaaattagccgggcatggtgatgtgtgcctgtagtcccagctacttgggaggctgagacaggagaattgcttgaacccaggaggcagaggttgcagtgagccaagatcgcgccactgcactccggcctgggcaacagagcgagactacatctc

SEQ ID NO: 407592 - DNA, 1365 bp, Homo sapiens
  misc_feature (1026)..(1026): n is a, c, g, or t
tttagcagtaggaggagaggcttttatcgttatgtcagaacttttccccagtggttttcctcttttgagtggaatgaaattgatgggggtggccaaaatgaagaggaacacttgtacctctacctcacactctttaggtcttagaatgtgctttatgttttcattttaggactcttgagaatttctatataccagtgtgtgacaattttgactgtttgtaaatattgttacatcctatcttgatggattgtttctggaaatgggctcccaccggaaacaaaaataatcttttattttgcttttgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatntcagattatttgcacatttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcagactatagccgttgtttcccaaacttcagtctctttagtactacttgtattattttcttaatatttatcttttaaattttaaagtttttttaaaaaaa

SEQ ID NO: 407593 - DNA, 1090 bp, Homo sapiens
  misc_feature (44)..(44): n is a, c, g, or t
aaaaaaaaaaaaaaaaaaaaaaaaaaaaagcggccgcccgaatnggggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctggtgagttctggatctcagttattttattttaaaaaaatccttgggaaaaactgagaaactcttgaaaatgaattactttattctaatattttaaatcaagtacatgagagaatatagaagttcaaagcaatcctttcagtgatttataaagtaagctaccagatgtgtgactaatcgggaaaatactttcaaatagcaacctcagaggatctctttgctagaaaaacatttttttaaatttaaaattaaaaaaagttaattttcatgggtacatattcggtgtgtaatatatttatggggtacatgagatattttgatacaggtatgcaatgtgtaataatcacattagggtaaatggggtattcatcacctcaagcatttattatttctttgtgttataaacatgtcagttgtgctctgttaatttttaaatgtacaataaattattgttgactgtag

SEQ ID NO: 407594 - DNA, 1330 bp, Homo sapiens
  misc_feature (44)..(44): n is a, c, g, or t
  misc_feature (991)..(991): n is a, c, g, or t
aaaaaaaaaaaaaaaaaaaaaaaaaaaaagcggccgcccgaatnggggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaaagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatntcagattatttgcacatttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcagactatagccgttgtttcccaaacttcagtctctttagtactacttgtattattttcttaatatttatcttttaaattttaaagtttttttaaaaaaa

SEQ ID NO: 407595 - DNA, 1328 bp, Homo sapiens
gctggtaccggccggaagtctaggatcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccaggtaggttttcttccattttaaagaaacacttaccattattgtttacttcgggtatcagttctaacaattgtgcattttaaataaattattaaaactctgagttctttgcttctcttttaatttgagcctcttttaactttgtgacctatgtctccattttgagtagacatacatcccagtgaacctgatgttaaccttcttcctgtgctgaggcttcagtggtggtatgtcatctgcctatggtagtaaagactacttctaggctgggtgtggtggctcatgcctgtaatcccagcactttaggaggccgaggtgggcagatcacttgaggtcaggagttcaaggccagctggccaacacggtgaaaccttgtctgtactaaaaatacaaaaattagccgggcatggtgatgtgtgcctgtagtcccagctacttgggaggctgagacaggagaattgcttgaacccaggaggcagaggttgcagtgagccaagatcgcgccactgcactccggcctgggcaacagagcgagactacatctc

SEQ ID NO: 407596 - DNA, 1778 bp, Homo sapiens
  misc_feature (1439)..(1439): n is a, c, g, or t
gctggtaccggccggaagtctaggatcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatntcagattatttgcacatttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcagactatagccgttgtttcccaaacttcagtctctttagtactacttgtattattttcttaatatttatcttttaaattttaaagtttttttaaaaaaa

SEQ ID NO: 407597 - DNA, 1471 bp, Homo sapiens
  misc_feature (1132)..(1132): n is a, c, g, or t
gtcgatctagcaggatctcgaggagatagcaggagttcattactacttataacatgatgaagacaaatactgctgtcagaccatactgtttcattgaatttgataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatntcagattatttgcacatttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcagactatagccgttgtttcccaaacttcagtctctttagtactacttgtattattttcttaatatttatcttttaaattttaaagtttttttaaaaaaa

SEQ ID NO: 407598 - DNA, 2733 bp, Homo sapiens
tgccattgctgggtataaaacgaggagctctctgttgacctgtaaatcattaatacttcttgacttagagtgaagtgacactctaagtcaagaagtattgaatgatttacaggtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtctggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgaagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaacactcaaaagat

SEQ ID NO: 407599 - DNA, 2692 bp, Homo sapiens
tgccattgctgggtataaaacgaggagctctctgttgacctgtaaatcattaatacttcttgacttagagtgtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtctggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgaagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaacactcaaaagat

SEQ ID NO: 407600 - DNA, 2679 bp, Homo sapiens
tgccattgctgggtataaaacgaggagctctctgttgacctgtaaatcattaatacttcttgacttagagtgaagtgacactctaagtcaagaagtattgaatgatttacaggtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtctggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaatccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgaagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaacactcaaaagat

SEQ ID NO: 407601 - DNA, 2679 bp, Homo sapiens
tgccattgctgggtataaaacgaggagctctctgttgacctgtaaatcattaatacttcttgacttagagtgaagtgacactctaagtcaagaagtattgaatgatttacaggtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtctggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgaagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaacactcaaaagat

SEQ ID NO: 407602 - DNA, 393 bp, Homo sapiens
gatggcttagcttgggctcagaggcctgacacctttcacctaagatgggccttgccacataggggtaggagaacagggatttttagagaacacctttgtcagaaaaggtcctattgaggggctggctgattgaagagtataccaagtcctgtggccatttgcctggtggctttcagggaggaaagagaataatgtgttctcgggtacattctcagtactgtgtaaaaaggcactagcacagactaggcacttctttgttaaaaaaaagtttgtagaaacagaatattgcagtgttgaccagggtgatctcaaactcctgacttcaagtagtcctcctacctctgcctcctaaagtgctgaaattacaggcatgaatcaccatacctggccaga

SEQ ID NO: 407603 - DNA, 389 bp, Homo sapiens
gggctgctggtcttcacttcctgactccaaaaggatatgataaaacctaccttcttggataactgcaagaattaaataatactttatgtaaaaaagtttaggcggggtctgggtgccgtggctcatgcctataatcccagtactttgggaggctgaggtgggtggatcacttgaggccaggagctcaagtccagcctggccaacatggtgaaacctcgtctctacttaaaaactacaaaaattagccaggcacggtggcatgtgcctatggtcctagctactcgagaggctgaggcaggaggatcgcttgaaccaaggaggtggaagtgagccaagattatgccactgaactccagcctgggcaacagagcgagactctgtctcaaaaa

SEQ ID NO: 407604 - DNA, 2219 bp, Homo sapiens
aaaaaatagaagataaagagaacaaaacaacaaaaaattatagaaactaaatccttatataattccactacttggggatacaattgtcaatactttatggatgtccttccagatatattctttgtatatacacacaaatataaataaacacacttgtaagatatataaagacatcaaattttaaatgttcttctatagtttttatttcactcaacatgttactaaacttttgagttcagtagacatacatcataccgccatattaatgccttcgattttctcattatatgaatgcatcaaaattttttgactaatctgaaggctatttttaaaatttatttatttttaattttttttctgaagaaaaaatgatttttttctatacaatgatgctagaagaaactgatttaaaagttacagctttgaatgttaaatgatgaagggttttggagtcattccttttgacctactaattttacaattctcttgaacatcaagtgttttttagtggtcatcatgtgatatttatgtgcatattttgggcatcactgttctaattcccattgactgacgtgttggggacctcattcatttctttcagttcttaaacctatagattgatactaatctattaatgtacttaaaatgtaaaggaaccccaggtgtttagacaattaaccaataaaaattatttctctcagtttctaaacctatagattgatactattaaatttatttaaaatgtaaaggaactccaggtatttagacaattaaaccaataaaaattaggtcaaagaacatcaaacttttcttttaagctaatataaaaatatctaagaccttctgctgattgtcacatagtataagggtatgtgagtaaatggttgctaaactgcattttggcactaacatatgaccagatccatctgttgggatcccatgccgtggtcccatggcagtgagctattgtggaaaatgtattctactgagtggagggagatgaaggaagtgatcactaaggttggtgagcttgaggggaggtctcttagcccctctagagctcagattgttcatcttcaaaaccatggtgctaaagaatatagctctaaatttttctccagtgcaaatattctatgcttctgtgacagagaactctgaagtcacatggcctaagtcagggcagctgctacagacccgagtactacagatccttggctgcttggtgtacatccctggccactgacctcttctcacccactgttctttctctcttaattgattctgtcctgacccaggactcagatcttaactgtgtatctgaacacctttgtcttgcactttctttcctcaattctcaattatgacctgtttcttgcttgtgttctgggcagtttttcatgtctcactgggttaacccaactacttgggtttcccataacccttagggctacaccgtaaatgtgctgcctgtgaccatggcatccaaggctcgtcataagactggactgggtctgcaccaactccatacatctggaagaaaagaaaagcttcaacacctcattaccttggacacagtaattacttggaagatgttagtacagatacatgtatgacatgaataaacttgaaaacattctgctgggtgaaagaagccaaacacaaaaggtgacatattgtatgattccatttatatgaaataatcagaaataaaaagtaggctagtgattgccaggggctgaggggaagggaaagcaggagtgaatggttattggtacagggtttcttttggggctgaatacaatgttctggaattagagaatggtgatggttgcacaaccttatgaatatactaaaaaccactgaattatacactttaaacatgttggattttattatatgtaaattatatatcaataaaaaatggttaggatgggaacgatagctcacgcctgtaatcccagcactttgggaggccgaggcgggcggatcatgaggtcaggagtttgagaccagcctggccaacatagtgaaaccctgtctctactgaaaatacaaaaattagctgggcatggtggcacacacctgtagtcccagctacttgggaggctgaggcaggagaatctcttgaacctgggagcagaaattatggtcagccaagattgcaccattgcactccagcctgggcaacagagcgagactccgtctcacaaaaaaaaaaa

SEQ ID NO: 407605 - DNA, 706 bp, Homo sapiens
  misc_feature (655)..(655): n is a, c, g, or t
  misc_feature (705)..(706): n is a, c, g, or t
aaaaaatagaagataaagagaacaaaacaacaaaaaattatagaaactaaatccttatataattccactacttggggatacaattgtcaatactttatggatgtccttccagatatattctttgtatatacacacaaatataaataaacacacttgtaagatatataaagacatcaaattttaaatgttcttctatagtttttatttcactcaacatgttactaaacttttgagttcagtagacatacatcataccgccatattaatgccttcgattttctcattatatgaatgcatcaaaattttttgactaatctgaaggctatttttaaaatttatttatttttaattttttttctgaagaaaaaatgatttttttctatacaatgatgctagaagaaactgatttaaaagttacagctttgaatgttaaatgatgaagggttttggagtcattccttttgacctactaattttacaattctcttgaacatcaagtgttttttagtggtcatcatgtgatatttatgtgcatattttgggcatcactgttctaattcccattgactgacgtgttggggacctcattcatttctttcagttcttaaacctatagattgatactaatctattaatgtacttaaaaaaaaaattngggggtttaaaaaaaaaaaaggggggggggaaaaaaaaaacccccccccnn

SEQ ID NO: 407606 - DNA, 445 bp, Homo sapiens
atttgtcaagattcctcattaaatgtaatagataattcaactgagtggctggaaggttttttctaaaggcctcaccggatgaagctggtgttatgcctaggaatctatagaatggaagtgctgtacaatgaatctgagactgacttcctctttgatacaggtcaagaaattgaagtttgttacttctgatctctctcagaatacattttgagataaatgtcacaataaaacataactgtcctgacctcagcactaccttttacatttttagacttttacagaagagtttatttctccagggatactaatatacattaaactacacatgtccatttaccctctgttttttgaagtataacccacaggacctggtaaacaaagtattgggttcattagggtgtgaatttgagcctacataaaatctagaactgtttgaacacatcag

SEQ ID NO: 407607 - DNA, 536 bp, Homo sapiens
gcaggctgtggtccagaactatgagcagacttgcctgtcactctccaaacatttactgaacacctactgtgtgccaggccctgtgctttgtcaggctctgggggagacaggtcattactctgcagtgtgggaagcggggctgccctggaagtgtgtactcagtgctgtgggggtacagagggagggctggagaacttagctggtgggaaaggagggttctggaaggcttcctcagaggtagtggcattgggccagaacttacagtagggaagagcatgtggcaaggcacagaggagatgggagcctgccctggtgaggggtccagtggtgacagagctcagtgtgggtccagagatggtgtcaggtgagggctgagaggggagggcaagtgccccttgagatgggctgaacgtgatgatgatctgtggccagtgggagatgatagaagtcttgaggttgggaatataagaattaggtctcttttagaaagagaggacatggagaaaatccatatatttttagctaccaaaaaaaaa

SEQ ID NO: 407608 - DNA, 401 bp, Homo sapiens
gcaggctgtggtccagaactatgagcagacttgcctgtcactctccaaacatttactgaacacctactgtgtgccaggccctgtgctttgtcaggctctgggggagacaggtcattactctgcagtgtgggaagcggggctgccctggaagtgtgtactcagtgctgtgggggtacagagggagggctggagaacttagctggtgggaaaggagggttctggaaggcttcctcagaggtagtggcattgggcttacaagggagggcgatctgtgtggacaagagtgttacagcacaaaagcatgtaaacaaaaaagcatggagcatctttaagaaatagcacggagtttgctgtgactggatctgctgagattggagggtgagaaggacgtgcaggcctgt

SEQ ID NO: 407609 - DNA, 708 bp, Homo sapiens
agaaagcaaactgggatggtgctgtgctatgggctagcaacagcaggaagtcatttctgtccctaggtctgaagagggaagcaggggagccaacaccaaggaaccagagatcttagagtctgaaagtctgcatgatagaagccatggcctttagtagagggatcttgcctactcttagcagcctggcttggaggggcctggggaaataataccccaacctctctcctcttcttcaatattgatgacttccattggttaatatcaaactggaagttggagagaaagggagtctatctatacaagtcagcaccctgtagcccagaagagagtaaaaagggggtaaaaagcaatttcccgaggggacaaaccagaaaacacccagcacagaaggaggaacaaacatttggaggaacaaacagaaaatatcagaaaacattttaatcctgggtcctgggacgtcatggaaggttttgaagttaggagcaccgccatcctctagggggagctcaagcatttctctccactcatcccaaaggcggtgcatcaaaagatcagggtgaaactgacttcaaggaaagagccctcggctagaggaagaagcctggagaagtaaagggattgctcctggaattggaaatctaccctttgcacttctatttactgcatttggattgatttgcaagaataaccattaaaataatcaaagct

SEQ ID NO: 407610 - DNA, 325 bp, Homo sapiens
atgcttagaaaggaggatagaatttggaggagcaggggctgggcacggtggctaatgctgtaatcccagcactttgggaggccgaggcaggtgaatcacttgaggccaggagtttgagaccagcctggtcaagatgatgagaccccatctctactaaaaatacaaaaattagctgggcatggtagcacgggcctgtggtcccagctactctggaggcagaggtgggaggatcacttgagcctgggactcagaggtagcagtgagccgagatcctgccacctgccactgaactccagcttgggtgacaagaatgagaccccatcaa

SEQ ID NO: 407611 - DNA, 2073 bp, Homo sapiens
ggaacataaaaactaagactatgtcagccccggtgttactcaggccgaggtatagaaggaggctatgatgaagcctacccatagggcttctggggctgaaacgagctaatgatgtcgaagctgctagaactgtacctgtgtcagagcgagtgtgcagcatacgttatcatcactgtcatcactccagcattctgactgtgcctttaaactagtgtgggattttgcccaaacctctaaaccctcccctagccgtggtttcccccgcagtctgaagactctaatacttgacactcgttcagagagatgtttggggaatttatagacacttaacatttatgcatccttatatatcgggtccaggaggaattacagacacttaaaccattactgccttcttcctcaaaagaataacagctttggtaactgggttagcagaggtgttagtggacttagggttgtaaacagatactcatggcactgacatcgatgagtctatgagggaaattagaaagataaatacatctgggatgtaaactcggaaaggcgaggctgttcaaaatgttggtgctattgaattgtgattctcggtgtttgtacattgctaataatgttaaaccatgaagcctgtgagatcttgtgttgcagcgtggtttggccctagcgttcttgcatgctaacctaaggtagaagattagcagcctgtttgcatgcagccggatgctgcccctgacgtgaagcatgttctgggaggttgacccaacctcctttggctgtggcctcattcaccccgtcctgtctgtggcctcattcaccgtgatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctgtctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcaaaaaaaaagt

SEQ ID NO: 407612 - DNA, 1344 bp, Homo sapiens
ctgagaagagtactgatggacacaaagtgccttctgtcatttgacatgctgcttcctttctgatgggctctaacttcagcttttcggtctcattcagagtagagaaattaacagattttactggcgggtgttttcagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctgtctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcaaaaaaaaagt

SEQ ID NO: 407613 - DNA, 1377 bp, Homo sapiens
cgtggtggctcatgcctgtaatcccagcactttgggaggccaaggcggacagatcacgaggtcaggagatcgagaccatcctggccaacatggcaaaaccccgtctctactaaaatacaaaaaattaactgagggtggtggcgcacacctgtagtcccgggaggctgaggcaggggaatcgcttgaacccgtgaggcggagcttgcagtgagccgagatcacgccactgcactccagcctgggcgactgagcgagattccatctcaagagaaaaaaaagagaaccatcaggatccccaagggtgttccctctctggagtccagttgtttcagaggaggaagggcatcatgagggaccaggggccaagttatcattttatttttcagtaggattggaatttcggtaacacagaaccctgttatgtttggaggaaacaagttccttaaagctcactggctttcctccgttcccagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctgtctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcaaaaaaaaagt

SEQ ID NO: 407614 - DNA, 1320 bp, Homo sapiens
cgtggtggctcatgcctgtaatcccagcactttgggaggccaaggcggacagatcacgaggtcaggagatcgagaccatcctggccaacatggcaaaaccccgtctctactaaaatacaaaaaattaactgagggtggtggcgcacacctgtagtcccgggaggctgaggcaggggaatcgcttgaacccgtgaggcggagcttgcagtgagccgagatcacgccactgcactccagcctgggcgactgagcgagattccatctcaagagaaaaaaaagagaaccatcaggatccccaagggtgttccctctctggagtccagttgtttcagaggaggaagggcatcatgagggaccaggggccaagttatcattttatttttcagtaggattggaatttcggtaacacagaaccctgttatgtttggaggaaacaagttccttaaagctcactggctttcctccgttcccagctccgctctgcattggataaaacagaagagctcgaggtgagcaacggccacttagtgaagcctctgatcaggcaactggttggtgactggagagcattgtttcataggcttttctctgtcctgtctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcaaaaaaaaagt

SEQ ID NO: 407615 - DNA, 2241 bp, Homo sapiens
gtaatttgactgtaaattaaaatagaactcaaaaggatgataaatttaatttatattgtgcttaacattatctggtgtttactgtgcctttcaaaacaacttaggatctttggaaaacataattagagaaaaatgtaacttggattagcatgtggctagatgattttttaaatgaaaatgaagatgcattttatatgaattattttcttttcacatggctaatcaaggttagtttttcattctatgaagaatctggaggtaggctctgcatgacagcagtgtcctagtgagctaagagctttgagtcagggtctgactcgggcgtgtgagtttggatctggaaaaacagcgggtgcagtgtttaggggagtgttcccgtggctgggccgcaaggcctgaagaaacttgcttagtggttctgggcctctgagcctcatctatagaaggaggctatgatgaagcctacccatagggcttctggggctgaaacgagctaatgatgtcgaagctgctagaactgtacctgtgtcagagcgagtgtgcagcatacgttatcatcactgtcatcactccagcattctgactgtgcctttaaactagtgtgggattttgcccaaacctctaaaccctcccctagccgtggtttcccccgcagtctgaagactctaatacttgacactcgttcagagagatgtttggggaatttatagacacttaacatttatgcatccttatatatcgggtccaggaggaattacagacacttaaaccattactgccttcttcctcaaaagaataacagctttggtaactgggttagcagaggtgttagtggacttagggttgtaaacagatactcatggcactgacatcgatgagtctatgagggaaattagaaagataaatacatctgggatgtaaactcggaaaggcgaggctgttcaaaatgttggtgctattgaattgtgattctcggtgtttgtacattgctaataatgttaaaccatgaagcctgtgagatcttgtgttgcagcgtggtttggccctagcgttcttgcatgctaacctaaggtagaagattagcagcctgtttgcatgcagccggatgctgcccctgacgtgaagcatgttctgggaggttgacccaacctcctttggctgtggcctcattcaccccgtcctgtctgtggcctcattcaccgtgatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctgtctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactcttgccccgactgcatcttgactttgttcatctcttcgagcgcttatcaagcttgt

SEQ ID NO: 407616 - DNA, 2101 bp, Homo sapiens
gtaatttgactgtaaattaaaatagaactcaaaaggatgataaatttaatttatattgtgcttaacattatctggtgtttactgtgcctttcaaaacaacttaggatctttggaaaacataattagagaaaaatgtaacttggattagcatgtggctagatgattttttaaatgaaaatgaagatgcattttatatgaattattttcttttcacatggctaatcaaggttagtttttcattctatgaagaatctggaggtaggctctgcatgacagcagtgtcctagtgagctaagagctttgagtcagggtctgactcgggcgtgtgagtttggatctggaaaaacagcgggtgcagtgtttaggggagtgttcccgtggctgggccgcaaggcctgaagaaacttgcttagtggttctgggcctctgagcctcatctatagaaggaggctatgatgaagcctacccatagggcttctggggctgaaacgagctaatgatgtcgaagctgctagaactgtacctgtgtcagagcgagtgtgcagcatacgttatcatcactgtcatcactccagcattctgactgtgcctttaaactagtgtgggattttgcccaaacctctaaaccctcccctagccgtggtttcccccgcagtctgaagactctaatacttgacactcgttcagagagatgtttggggaatttatagacacttaacatttatgcatccttatatatcgggtccaggaggaattacagacacttaaaccattactgccttcttcctcaaaagaataacagctttggtaactgggttagcagaggtgttagtggacttagggttgtaaacagatactcatggcactgacatcgatgagtctatgagggaaattagaaagataaatacatctgggatgtaaactcggaaaggcgaggctgttcaaaatgttggtgctattgaattgtgattctcggtgtttgtacattgctaataatgttaaaccatgaagcctgtgagatcttgtgttgcagcgtggtttggccctagcgttcttgcatgctaacctaaggtagaagattagcagcctgtttgcatgcagccggatgctgcccctgacgtgaagcatgttctgggaggttgacccaacctcctttggctgtggcctcattcaccccgtcctgtctgtggcctcattcaccgtgatattaggttgaaaaagctggttgatgaacgggaatgcttattggaacaggtaacaatctttttattactttaccggttcatgaacagggcacctgaaaccacctgcccatccttccttcttgcttactcagaaaacccctaagttaatcatgtctgaaagtctttatcaagccaactggtgttcttaagattgctatccaaatagaacatcaaagttaatattttcatccaaagagaacatcctgagtcatatgaggtttaataaggatgtctcaaagacccaaagccatggaattgaatttggtacattttactgaattgctgcttaaaataaatataaatgttgattattaataatattaatgattaactgttgagagacaagagcattactgagtcattccaaatagcacttctcttgtccatatgggttgtttgtccataaaagtcagttttgtactcttggtgatcagcacccctctctcacaggtgtttctttgttacagctaaacaaagttgttttaaccatgtttatcttcattgctctctcctacctcaagaagtagcaggccaggtgcagtggctcacacctgtaatcgtagcactttgggaggccaaggcgggcggatcacttgaggtcaggagttcaagagcagtctgccaacatggtgaaaccccgtctctactaaaaatacaaaaattagccgggtgtgatggtgcgcgcccgtaatcccagctactgggaggtgaagagaaattcttgaaccggaagcaaagtgcgtggaccgatcgcacatgcttccactggttagaaaggaatccttaaaacagaactcgaagtctttcgttttttcggggggtatactcacccttctttctagacaagtgtttctcca

SEQ ID NO: 407617 - DNA, 2012 bp, Homo sapiens
ctgagaagagtactgatggacacaaagtgccttctgtcatttgacatgctgcttcctttctgatgggctctaacttcagcttttcggtctcattcagagtagagaaattaacagattttactggcgggtgttttcagattaagaaactcaaagggcagctggaggagagacagaagattggcaaactagacaatcttcgatctgaagatgatgtcttggaaaacgggacagacatgcatgtaatggacctacaaagtaaatgtcaattcttgtgtagaagtaaatgctttcacatgtgctgttttagtatacttgtgctggcagagaaaactgtcacggcaaagaatgccctcattccctcacatccccacaaaagcccttaaaaataaaagcacaaggaggggtaggtagacagaacaatggtgtttctctctgagcctatgaaatagaacaggtacccaaaaacgtgcaccaagataccaccacatgttgtgccgatggaaaccacatttactttgctggatacagcaatctttcgatctgttgattgtatgaaaaaaaaaaaaatgaaaggcttttttcatgctaataaactagaaacagtcttaagggagataaaattatgcccagtctctctccgcccttttccctaccccctaccatctctttgtcttcttcactcataggcactctcttgcctgaggtttcctgccccaagcacaggggcggaaggcactttccctgggttcatggggagagagtgccttctcctactctcagctctgggaggttgtggaggcagggccagaactaacagatttgtgagatgattacaaagtaagggcttggttcccagtaactattgttttaatatttgaaaagcccaagagcttaacagattttccttctctttcaacctttaggggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctgtctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcaaaaaaaaagt

SEQ ID NO: 407618 - DNA, 862 bp, Homo sapiens
cttatgttaccactttgtgttcctttctccccatctctttcaggttcactgatcagttgtacgcactttggtctctttacgaaatcccatatttcttggaggttttgttcattgtttcataggcttttctctgtcctgtctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcaaaaaaaaagt

SEQ ID NO: 407619 - DNA, 2461 bp, Homo sapiens
gtaatttgactgtaaattaaaatagaactcaaaaggatgataaatttaatttatattgtgcttaacattatctggtgtttactgtgcctttcaaaacaacttaggatctttggaaaacataattagagaaaaatgtaacttggattagcatgtggctagatgattttttaaatgaaaatgaagatgcattttatatgaattattttcttttcacatggctaatcaaggttagtttttcattctatgaagaatctggaggtaggctctgcatgacagcagtgtcctagtgagctaagagctttgagtcagggtctgactcgggcgtgtgagtttggatctggaaaaacagcgggtgcagtgtttaggggagtgttcccgtggctgggccgcaaggcctgaagaaacttgcttagtggttctgggcctctgagcctcatctatagaaggaggctatgatgaagcctacccatagggcttctggggctgaaacgagctaatgatgtcgaagctgctagaactgtacctgtgtcagagcgagtgtgcagcatacgttatcatcactgtcatcactccagcattctgactgtgcctttaaactagtgtgggattttgcccaaacctctaaaccctcccctagccgtggtttcccccgcagtctgaagactctaatacttgacactcgttcagagagatgtttggggaatttatagacacttaacatttatgcatccttatatatcgggtccaggaggaattacagacacttaaaccattactgccttcttcctcaaaagaataacagctttggtaactgggttagcagaggtgttagtggacttagggttgtaaacagatactcatggcactgacatcgatgagtctatgagggaaattagaaagataaatacatctgggatgtaaactcggaaaggcgaggctgttcaaaatgttggtgctattgaattgtgattctcggtgtttgtacattgctaataatgttaaaccatgaagcctgtgagatcttgtgttgcagcgtggtttggccctagcgttcttgcatgctaacctaaggtagaagattagcagcctgtttgcatgcagccggatgctgcccctgacgtgaagcatgttctgggaggttgacccaacctcctttggctgtggcctcattcaccccgtcctgtctgtggcctcattcaccgtgatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctgtctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcaaaaaaaaagt

SEQ ID NO: 407620 - DNA, 2006 bp, Homo sapiens
cctccatctacagcctcgtggcggacgggacctgttaggacactgccattgtgggtaacaaggacccgccttccatctgggccgccgtcccagggaaaaccttcctcaacatcacgccagctgaggttggtgtcctggttggcaaagactggtcaagctttgtcatgaatgggctgacactggggggccagaaatatactgtggtcctggactcactgctgcaggatggggaattgaccacggatcttcgtatgaagagcatcggtggagcccccaccttcaacgtcattgtcaccatgactgccaagacgctaggcctgctgatgggcaaagaaggtatccatggcaatttcatcgacaagtaatgttatgaaatggcctcccaccttcagcgttcccagtactgacctcctttgttccttccactccaccgctccccacagctttgcccgcctttccttcacatacacacaccattttaatttcaggagtcattactccacacaccttattgctgccaaaaccacatgggctgggggccagggatagatggacagacaccttcccccacccatacccctcctgtgtgtggctggaaaacttttttgttttgatggattttttatgaataaaaaagtttctactaaaaaaaatcaataactgtacatatgtgggcatattgtttgagtctgtattctttcactttgatgtatttatgaatactgacaccattactactgttttaaaattactgtagctttaaaatcaggtttgaaatctagcagagtaagtcctccaacttattgcttcttcaataccgacttgcttattctaggttctttgattttcaaatacattttgaaactagctttcaaatttctctaaaatctcctactagaaatattaagcagaattgtgttgatgtaatatgctaacaaaattgagtcttccaagcaatgaacatgatatatatttatttagccttctttaatttttctcaccaattgcttttaggggccttgtacctgcttcattgcatgtattgttaagcatgtaatgattctggctgttaatctctattatgttttattgaatttcattttctagctgctaattgctagtatggagaaattaagatgatgaaatcaactttataaaggcataatttcggtacaacagactgcaccactttaaaatgtgtaattcaatgcacgtttacaaatggatacactaacggaactactgccacaaccaagatagaggaaattccctatgccccaaagtttcttgtacccctttgcagttcatcagcctttcaaccctcagccccaaggagccactgtcacttcaggtccgtttgcatttttaaccattttctataaatgaaatgatacctgtgttcttttgtgtctgccttctttcatgcatcaatgtaattttaaaatccatctgtaatgtcttgtaaatactgagtagtattccttcgtgtggctataccatgtatgtttgtactttcacttattattggacatttctatcattccacgtttgggctattatgaagaaactatcatgagcatccatacgtggcaggccaggtctcactaacacaggcctccctaacaactgtttcagtaccgactgagtggttcaattaaatattaagaggaaaaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattaaacgagttttattgggggtctgaagaaactccccaggcctccacaaacaagtttattggagatctgaagggactctccaaacctctgtgatttagcaggagacaagataagggaccccagcacctagacccatttagattaactgaatttaactgaggttccagaggaaggtcttcaggactcagacttagtta

SEQ ID NO: 407621 - DNA, 664 bp, Homo sapiens
tgttctgtggtggatgatggaataaacaggtttcgaggcctggctcagcagccgctgcaggtgctggtggtgctggagctctgtgtgttcctgagccgctgtctgctcggtgttttcaggcggagctctgggccccatgtagggcactcgtctcggtaccgtctccattctcgtccgtgcagtgggaagtgaaatgtcagcactgtatgatcatcgtgggtgggaaggccccgctcccctacttggagctgcatttcacagtggtcttctgtaggtagatgtactgcgatcccagggtatgcttgagctgaatcattaaaagtcagagatatttgtcaacgtattttagctcctttcctactgtccttcacctagcgagatgatctgttaggggtataaggtagctgttcgagaggggttctcagctccctgacacctgttgtactctgttgatctccaacaatgtccctttgcagtactttaggaagaatcatcaaagtaactcaggaggtgattgactaccggaggtggatcaaagagaagtggggcagcaaagcccacccgtcgccaggcatgggtgagagattaattcatttgtgttcatcctaaccactggctggcatgttcatgcagaagtgtctctattcctttgtggtaaattggt

SEQ ID NO: 407622 - DNA, 378 bp, Homo sapiens
atggttttcctctgattgctttggtacccatggccgtctctcattttgttcctagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataaggtatagctctgtcctggtgcattcacctacctgttcaagctgccatgtgagaggcggtgctaaatgttttctcctccagagagaattccagagagatcatttgaaaacggaatttgctttgttgtcattcagccgtcgacgcggccgcgaatttagta

SEQ ID NO: 407623 - DNA, 3805 bp, Homo sapiens
gtgcggccgctctcagcggagggggcggccccggggcccaggcgccgcggcccggcaccccgtggaagagccgcgcgtacagcccgggcatccagggactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgccgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaacca

SEQ ID NO: 407624 - DNA, 3806 bp, Homo sapiens
gtgcggccgctctcagcggagggggcggccccggggcccaggcgccgcggcccggcaccccgtggaagagccgcgcgtacagcccgggcatccagggactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgccgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggtattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaacca

SEQ ID NO: 407625 - DNA, 3440 bp, Homo sapiens
ttgaggataaaccttatgctctgacccaccatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgccgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaacca

SEQ ID NO: 407626 - DNA, 3439 bp, Homo sapiens
gttagtcacattagcagcgttcccggctcagcagagcccgtgactgatgctgccggggcggctccacgccgcagttctcaggagttattaaccaaggctttttccctccacagacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgtaagtgccctcccctcctccgtgtgtctgttggacagtttgtgtctctggtaaatgtccatagccgcgagcttaaaatctcccccttggttttgctcaggttttgtttccttgtatgtgtgtggaggtgggtggggggcagccccgtgatgtgggcaccaggcttcctttcccctgccgtgaaccttcagaacctgtctgtgcgactcatgcagctgtcgagggcagtaatcctctaaatggttgaactacagtggacttccttgagtagtttttaaaaatttatttgaagattaaaaaaaaaattaaatccaagtatctcttctgtatttcctttaacattctttttcagttgtgatgaaattacttgaaggaagcctgggtaggtttgggctgcctgttcagaagttagacttaatttgaataacctttcatagccagcctggatgcaggcgtttcttttcatagctttaaggaagtagtagtgcacctttgtggtacagctgtcctttttgttttttgtaccgggttcaaggattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaacca

SEQ ID NO: 407627 - DNA, 807 bp, Homo sapiens
acctcggcctactgtttgagattctcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaacca

SEQ ID NO: 407628 - DNA, 1723 bp, Homo sapiens
gtgcggccgctctcagcggagggggcggccccggggcccaggcgccgcggcccggcaccccgtggaagagccgcgcgtacagcccgggcatccagggactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgccgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataaggtatagctctgtcctggtgcattcacctacctgttcaagctgccatgtgagaggcggtgctaaatgttttctcctccagagagaattccagagagatcatttgaaaacggaatttgctttgttgtcattcagccgtcgacgcggccgcgaatttagta

SEQ ID NO: 407629 - DNA, 418 bp, Homo sapiens
aaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccaggtaagggcgccctgatctccactgctgagagctgggccagcctcggggacgtgctggtgacagggcctgtgttggggctctgagagccccgggcagttcatttgctcttgatgcaggtttctcttatactaaccagttaataatcacactttgagaaatccttatttaatgcttctaattaacttttgtctttctaactgtttacattctataataaagaagaattaaggaaaatcttt

SEQ ID NO: 407630 - DNA, 3859 bp, Homo sapiens
gtgcggccgctctcagcggagggggcggccccggggcccaggcgccgcggcccggcaccccgtggaagagccgcgcgtacagcccgggcatccagggactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgccgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaacca

SEQ ID NO: 407631 - DNA, 4279 bp, Homo sapiens
gtgcggccgctctcagcggagggggcggccccggggcccaggcgccgcggcccggcaccccgtggaagagccgcgcgtacagcccgggcatccaggggtgagtgcgcggggaggccgcgggggcgggggcggggcccatggtcctggccggcgcccgcggtgcagacacccgtcccaggcgcccgggcttttggaggatggatgttgaaggctaaggccaaggcccgactctgcactgaaagttttttttttaaacatcagactcatttatcgtggagtgacttgcccagatcctacaagtaacagtccaagaaaaggggctgctgggtaggacctgcaggtatttgtcttttttactcttgagattggaacgggaaatcgactctctacccctccaccccgcctccgggcaagtgaggaaccccttgtcaaagtggggcgtagataagtgtggagtttcacgtaagttaagttgcagaataatttagcattgccaggaactcgaatcacgtcgaagactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgccgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaacca

SEQ ID NO: 407632 - DNA, 3368 bp, Homo sapiens
tgttctgtggtggatgatggaataaacaggtttcgaggcctggctcagcagccgctgcaggtgctggtggtgctggagctctgtgtgttcctgagccgctgtctgctcggtgttttcaggcggagctctgggccccatgtagggcactcgtctcggtaccgtctccattctcgtccgtgcagtgggaagtgaaatgtcagcactgtatgatcatcgtgggtgggaaggccccgctcccctacttggagctgcatttcacagtggtcttctgtaggtagatgtactgcgatcccagggtatgcttgagctgaatcattaaaagtcagagatatttgtcaacgtattttagctcctttcctactgtccttcacctagcgagatgatctgttaggggtataaggtagctgttcgagaggggttctcagctccctgacacctgttgtactctgttgatctccaacaatgtccctttgcagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaacca

SEQ ID NO: 407633 - DNA, 2487 bp, Homo sapiens
gtgcggccgctctcagcggagggggcggccccggggcccaggcgccgcggcccggcaccccgtggaagagccgcgcgtacagcccgggcatccagggactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgccgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggttgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccatggataagcttgggaggtcattgttttactgccctcacattttgtttgaaatttcagaactgtttttctatgtaaatattgcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaacgcttcgttcacctgtaggctttccctaggggctagactccgtcccctgtgatgctgccg

SEQ ID NO: 407634 - DNA, 2237 bp, Homo sapiens
gtgcggccgctctcagcggagggggcggccccggggcccaggcgccgcggcccggcaccccgtggaagagccgcgcgtacagcccgggcatccagggactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgccgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgtaagtgccctcccctcctccgtgtgtctgttggacagtttgtgtctctggtaaatgtccatagccgcgagcttaaaatctcccccttggttttgctcaggttttgtttccttgtatgtgtgtggaggtgggtggggggcagccccgtgatgtgggcaccaggcttcctttcccctgccgtgaaccttcagaacctgtctgtgcgactcatgcagctgtcgagggcagtaatcctctaaatggttgaactacagtggacttccttgagtagtttttaaaaatttatttgaagattaaaaaaaaaattaaatccaagtatctcttctgtatttcctttaacattctttttcagttgtgatgaaattacttgaaggaagcctgggtaggtttgggctgcctgttcagaagttagacttaatttgaataacctttcatagccagcctggatgcaggcgtttcttttcatagctttaaggaagtagtagtgcacctttgtggtacagctgtcctttttgttttttgtaccgggttcaaggattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcaggtacgtggccctctggcacccttcccgctggtggcccctgggaacagcatccgagctgtgatatgcactagaggagattgatggtcctttgaattagaagagtaactttttgagtctttggccattggtgtgttgttctaggaaatcctctcttttttgtggtgttgaggtcccccatgtatagtttcagcagcgaggacactgtggttcttgagtgctgccgtggcttttcacgggggccaggttgactgccttcctgcaagtttcctcactgccccagcatgagactgctgtcgagggtc

SEQ ID NO: 407635 - DNA, 1036 bp, Homo sapiens
catctgtacaaaaaataaaaataaattaacagggcgtgttggtgcacacctgtggtctcaccactttaggaggatgaggcggaggattgcttgagcctgggaggtggaggctgtagtgagccatcattgcacaactgcactccagcctgagtgacagagcaagaccgtgtctcattaaaaaaaaaattaaggtaaatttgcatactgtaaaaattactctttttcatgtaacccaggttaaaaagtttcaagagttttggcaaactcatacagctgtataaccactaccacaatcaagatagagagtatttccatcacccccaaaatattatctgtggtggtaccattttgactcccaccagcaatgtatgatacttctagttgatgtgcatccttgtcagcacttgatattgtcagtttttaaattttagccattatagtgggtatttagtggtatctcatcatagtttcattttgtgttccctaaatctctgatgatgctgaacttctttttatgtgtttatttgctgtccaaataacttccttggtgaagtgttcaaactgctgccattttttaaaaactgaattgtttgagtgcttattattgtgggtttttaatgtaattctgtttacaagtactttgttgaatatgtgttttgcaaatgtttttcccagtctatggtttatatttttatcgtcttagtaatgtcttttttttttcagaaattcttattatgataaaatacatataacattaaatttagcagtggctcacacctgtaatcccagcactttgggaggctgaggcgggtggatcacgaggtcaggagttcaagaccagcctgactaacatggtgaaaccccgtctctactaaaaatacaaaaattagccaggtgtggtggtgcacgcctgtaatcccagctactcaggaggttgaggaaggagaatcgcttgaacccaggaggcaaaggttgcagtgaaccgagattgcgcctctgcactccatcctgggtgacacagtgagactctgtctca

SEQ ID NO: 407636 - DNA, 2844 bp, Homo sapiens
  misc_feature (1424)..(1424): n is a, c, g, or t
  misc_feature (1449)..(1449): n is a, c, g, or t
  misc_feature (1539)..(1539): n is a, c, g, or t
actcactatagggctcgagcggccgcccgggcaggtggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacgggttacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcattccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattanggacacttccctctggactctcacntcttcagcagcaaaaagccaatgttgccggccaagttcgggcagccccaaggatccccttgtgaggtggcacgctttttcctgagcacantgccagccagcggtgaatgccagtggcattatgccaaccccctagtgcctagcagctcgtctccagctaaaaatcctccagagccaccggcgaacactgctaggcacagcctggtgccaagctacgaaggtgggtcaggtctgctcgtggggaaggtgggaggactgcgcacggccgggagccgaagcagccatggcggtgggtggcagatggagacagaaccctcacgctttgggcaaacttgccctctttctgcttctaagtagggcttgctgtgctttcttgctctcaatgcaggtgctcctcgagagtgagaaatggcagtctgcctgcctcggggacactagtgacagtataaagggcaaaggaaaaccgagtatctggccttcacgtaaatcctggccacattcaccaaccaaagggggacagtgattttcaaaaccagctcccatgtgctgagaacaccccagctgcatttcttttgcaagattcctttccactccaaccagaagtgaatatttgagacaaacggcctattggctattttcccatgccagttttggaagtggggaaaactatggtggaaatttgtgggcttggggacagaaatgccactcaccaacccagggcaaagaacacaaaccctccaggcctcagtttcttcacctgtaaaatggggtgaagctgtgatgtgcctactcccaaggacacgacacacagtagggacctgccctgtacatgctagttcaacagaaaggaatggcctttcaccttctcctggtggcaggcaagcagatgtcctctgcggagataccgccagctccccaggacgcagactgactcctgtttgctcgctggaccaaccccaggcagaaggtggaaggtgggaacagaggtttagctgcaggacatgtattcccattgcaccgagacctaactgccgctcagagtgtagaccgagatggtgcagatgcctgcagtgccattaaaatgtgggtgaaggtgacatcaggattatgtgccccaggccgggctcagtggctcacacctgtaatcccagcactttgggaggccaaggtgggcggatcacctgaggtcaggagtttgcgacaagcctgccaacaagctgaaaccccatctccactaaaaatacaaaaattagttgggcatggtggtgagcacctgtaatcccagctactctggaggctgagataggaggatcacttgaacccgggaggtggaggttgcagtgagctaagatcacatcactgcactccagcctgggtaacagagtgagactgtctc

SEQ ID NO: 407637 - DNA, 4382 bp, Homo sapiens
  misc_feature (1581)..(1581): n is a, c, g, or t
  misc_feature (1606)..(1606): n is a, c, g, or t
  misc_feature (1696)..(1696): n is a, c, g, or t
ggtccagcccggaggaggctgcgctccgggcagcggcgggcggcgccgccgggttgctcggagctcaggcccggcggctgcggggaggcgtctcggaaccccgggaggccccccgcacctgcccgcggcccactccgcggactcacctggctcccggctcccccttccccatccccgccgccgcagcccgagtggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacgggttacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcattccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattanggacacttccctctggactctcacntcttcagcagcaaaaagccaatgttgccggccaagttcgggcagccccaaggatccccttgtgaggtggcacgctttttcctgagcacantgccagccagcggtgaatgccagtggcattatgccaaccccctagtgcctagcagctcgtctccagctaaaaatcctccagagccaccggcgaacactgctaggcacagcctggtgccaagctacgaagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccaccgcggaggccccgcgcgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtcccgctgggggattgaagcggtttcactccgcaaatatcctccactttcaggagggaaaacccaccctaccacagtccgctcttccaagtggacggcagacctgggaggggacgcctgtgtcacgagcccttttagatgcttaggtgaaggcagaagtgatgattgtaagtcccatgaatacacaactccactgtctttaaaagtcattcaagagtctcattatttttgtttttatttaaccctttcttcaatacaaaaagccaacaaaccaagactaagggggtgaccatgcaattccattttgtgtctgtgaacataggtgtgcttcccaaatacattaacaagctcttacttccccctaacccctatgaactcttgataacaccaagagtagcaccttcagaatatattgaataggcattaaatgcaaaaatatatatgtagccagacagtttatgagaatgaccctgtcaagcttcattattacgtggcaaaatccctctggcccacacagatctgtaattcactaggctcgtgtttgctacaaatagtgctaataaagttaaattgcacgtgcaatacggaacactgtcaatggactgcaccttgtgaaggaaaaacatgcttaagggggtgtaatgaaaatgatgtagacattttaagcattttctacacagcgagaaaacttcgtaagaacatgttacgtgtgcaacaggtaaacagaaatcctttcataaagcaccagcagtgtttaaaaaatgagcttccattaatttttactttttatgggttttgcttaaagatctcaacatggaaaaatcctgtcatggctctgaactgcacaatgcattgaaccgccgtccttcaattttcttcacactatcaacactgcagcattttgctgctttatcaaaatggtttattttaggaaactttttccacctttctgaatggaaagaggttttcacaaatgttttaaactcatcgttctaaaatcaagtgcacctacaccaactgctctcaaaatgtgaactgacttttttttttttttttttgccaaccctgtgtcacttagtgaggacctgacacaatccctacagggtgtctgtcagtgggcctcatggtaagagtcacaatttgcaaatttaggaccgtgggtcatgcagcgaaggggctggatggtaggaagggatgtgcccgcctctccacgcactcagctatacctcattcacagctccttgtgagtgtgtgcacaggaaataagccgagggtattatttttttatgttcatgagtcttgtaattaaaccgtgattcttgaaaggtgtaggtttgattactaggagataccaccgacatttttcaataaagtactgcaaaatgcttttgtgtctaccttgttattaacttttggggctgtatttagtaaaaataaatcaaggctatcggagcagttcaataacaaaggttactgttgagaaaaaagaccctatcatagatttacaagtgacaacgtggacaggcgtaacagagtgtgtatgtacttgaaaatgtgtactagtgaaaacgtccttgtctaaacaaacttcgttttcataacctagaacatgaaggaagattcttacacgagctggcttcaggacggccagggctgagtgtgaagtcagcagagctgttactgtggcaacctaatattgtgacctccatcttgaagagtctgcacatttaagctggggatagcgtttcttgacttctgtgaggctccggcaggggaagaggaagcattttaatacatatgcctctcttttaca

SEQ ID NO: 407638 - DNA, 1530 bp, Homo sapiens
ggtccagcccggaggaggctgcgctccgggcagcggcgggcggcgccgccgggttgctcggagctcaggcccggcggctgcggggaggcgtctcggaaccccgggaggccccccgcacctgcccgcggcccactccgcggactcacctggctcccggctcccccttccccatccccgccgccgcagcccgagtggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacgggttacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcattccaaatggacaaactggaatgcggccagctcggaaactggagagccagtccccctgcaagggaagaggaagcattttaatacatatgcctctcttttaca

SEQ ID NO: 407639 - DNA, 382 bp, Homo sapiens
aaggcctctgggtgctgcatctggccctgggaacacattggtgcggttggaataaggatgggggaagcacggagggacagctgccaacctcatcttgctcctgcttgcagagtatgagatagagaggtcgttctttcttcgaatgaaatgtgtcttggcgaaaaggaacgcgggcctgacctgcagcggatacaaggtacggggagtcatgggtgcggggaggagctggctaagggtcttcaatgtgtgttttcaagagcgtctgcagaaaggaaggcacgggagcacaaactcgtcatccccactaatgtagagctctccagcaacgtggtgcacagtctcttggaggctcatgtgagagctggtgttttaggaggatgtt

SEQ ID NO: 407640 - DNA, 4225 bp, Homo sapiens
  misc_feature (1424)..(1424): n is a, c, g, or t
  misc_feature (1449)..(1449): n is a, c, g, or t
  misc_feature (1539)..(1539): n is a, c, g, or t
actcactatagggctcgagcggccgcccgggcaggtggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacgggttacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcattccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattanggacacttccctctggactctcacntcttcagcagcaaaaagccaatgttgccggccaagttcgggcagccccaaggatccccttgtgaggtggcacgctttttcctgagcacantgccagccagcggtgaatgccagtggcattatgccaaccccctagtgcctagcagctcgtctccagctaaaaatcctccagagccaccggcgaacactgctaggcacagcctggtgccaagctacgaagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccaccgcggaggccccgcgcgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtcccgctgggggattgaagcggtttcactccgcaaatatcctccactttcaggagggaaaacccaccctaccacagtccgctcttccaagtggacggcagacctgggaggggacgcctgtgtcacgagcccttttagatgcttaggtgaaggcagaagtgatgattgtaagtcccatgaatacacaactccactgtctttaaaagtcattcaagagtctcattatttttgtttttatttaaccctttcttcaatacaaaaagccaacaaaccaagactaagggggtgaccatgcaattccattttgtgtctgtgaacataggtgtgcttcccaaatacattaacaagctcttacttccccctaacccctatgaactcttgataacaccaagagtagcaccttcagaatatattgaataggcattaaatgcaaaaatatatatgtagccagacagtttatgagaatgaccctgtcaagcttcattattacgtggcaaaatccctctggcccacacagatctgtaattcactaggctcgtgtttgctacaaatagtgctaataaagttaaattgcacgtgcaatacggaacactgtcaatggactgcaccttgtgaaggaaaaacatgcttaagggggtgtaatgaaaatgatgtagacattttaagcattttctacacagcgagaaaacttcgtaagaacatgttacgtgtgcaacaggtaaacagaaatcctttcataaagcaccagcagtgtttaaaaaatgagcttccattaatttttactttttatgggttttgcttaaagatctcaacatggaaaaatcctgtcatggctctgaactgcacaatgcattgaaccgccgtccttcaattttcttcacactatcaacactgcagcattttgctgctttatcaaaatggtttattttaggaaactttttccacctttctgaatggaaagaggttttcacaaatgttttaaactcatcgttctaaaatcaagtgcacctacaccaactgctctcaaaatgtgaactgacttttttttttttttttttgccaaccctgtgtcacttagtgaggacctgacacaatccctacagggtgtctgtcagtgggcctcatggtaagagtcacaatttgcaaatttaggaccgtgggtcatgcagcgaaggggctggatggtaggaagggatgtgcccgcctctccacgcactcagctatacctcattcacagctccttgtgagtgtgtgcacaggaaataagccgagggtattatttttttatgttcatgagtcttgtaattaaaccgtgattcttgaaaggtgtaggtttgattactaggagataccaccgacatttttcaataaagtactgcaaaatgcttttgtgtctaccttgttattaacttttggggctgtatttagtaaaaataaatcaaggctatcggagcagttcaataacaaaggttactgttgagaaaaaagaccctatcatagatttacaagtgacaacgtggacaggcgtaacagagtgtgtatgtacttgaaaatgtgtactagtgaaaacgtccttgtctaaacaaacttcgttttcataacctagaacatgaaggaagattcttacacgagctggcttcaggacggccagggctgagtgtgaagtcagcagagctgttactgtggcaacctaatattgtgacctccatcttgaagagtctgcacatttaagctggggatagcgtttcttgacttctgtgaggctccggcaggggaagaggaagcattttaatacatatgcctctcttttaca

SEQ ID NO: 407641 - DNA, 2343 bp, Homo sapiens
  misc_feature (1581)..(1581): n is a, c, g, or t
  misc_feature (1606)..(1606): n is a, c, g, or t
  misc_feature (1696)..(1696): n is a, c, g, or t
ggtccagcccggaggaggctgcgctccgggcagcggcgggcggcgccgccgggttgctcggagctcaggcccggcggctgcggggaggcgtctcggaaccccgggaggccccccgcacctgcccgcggcccactccgcggactcacctggctcccggctcccccttccccatccccgccgccgcagcccgagtggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacgggttacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcattccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattanggacacttccctctggactctcacntcttcagcagcaaaaagccaatgttgccggccaagttcgggcagccccaaggatccccttgtgaggtggcacgctttttcctgagcacantgccagccagcggtgaatgccagtggcattatgccaaccccctagtgcctagcagctcgtctccagctaaaaatcctccagagccaccggcgaacactgctaggcacagcctggtgccaagctacgaaggcaagcagatgtcctctgcggagataccgccagctccccaggacgcagactgactcctgtttgctcgctggaccaaccccaggcagaaggtggaaggtgggaacagaggtttagctgcaggacatgtattcccattgcaccgagacctaactgccgctcagagtgtagaccgagatggtgcagatgcctgcagtgccattaaaatgtgggtgaaggtgacatcaggattatgtgccccaggccgggctcagtggctcacacctgtaatcccagcactttgggaggccaaggtgggcggatcacctgaggtcaggagtttgcgacaagcctgccaacaagctgaaaccccatctccactaaaaatacaaaaattagttgggcatggtggtgagcacctgtaatcccagctactctggaggctgagataggaggatcacttgaacccgggaggtggaggttgcagtgagctaagatcacatcactgcactccagcctgggtaacagagtgagactgtctc

SEQ ID NO: 407642 - DNA, 606 bp, Homo sapiens
actcactatagggctcgagcggccgcccgggcaggtggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccagtcttcaccccgtcagccttgttccgagattctgccaaaacccggactatctgcttatgtagtaatgctagatgccctgaaaagagctccacaaagggacatgtttcagtccacacttgctggtctgcacgttacggtattatgagttgctataaagcaagaggtaa

SEQ ID NO: 407643 - DNA, 390 bp, Homo sapiens
tactctgctcgttcaaactctggataaaaagaataaatagggatagttgttaactatttgtgttgttacagggatcaagatcacgggttagagtttgtatgaaaagcaaggtgttggtagaattaaggcaagttttttttttttttttctgccaaaagtggtccgctctttataacttagctgtgggagaacttttgaagaatgtggttcaagagaaggactagctaacagagaagattttaaaatatataccttaaaaataattttatgatagtaaattccaaaggtatatgaaaatagaaaaatagtagaatgaattcttaggtactcaccacctggcttcaataatggccaactcatgcccagtagggcaaatattaaatattaaaa

SEQ ID NO: 407644 - DNA, 422 bp, Homo sapiens
aatgcacaaaagtcaaatcagaatggaaaagactcaaaaccatcatcaacaccaagatcaaaaggacaagaatccttcaaaaaacaggaaaaaactcctaaaacacctaaaaggacctagttctgtagaagacattaaagcaaaaatgcaagcaagtatagaaaaatgtggttctcttcccaaagtggaagccaagttcatcagttatgtgaagaattgcttctggatgactgagcaggaggctattcaagatttctggcagtggaggaagtctctttaagaaaacagtttaaacaatttgttaaaaaatttccatcttatttcatttctgtaacagttgatatctggctgtcctttttataatgcagagtgagaactttccctaccatgtttgataaatgttgtccaggttccattgccaa

SEQ ID NO: 407645 - DNA, 357 bp, Homo sapiens
gatgaatagggcttaattttctcatgataaacctaagtagaagctatgaaaattcttaccacacttcagtgaattatcttgtatacctctagagtgagcacattccactttggagatcagtagtctcagcaacaagacctgtggccataaagtgggaataaacaatccaatttttagcaatgcttggcccagattcacttatgagtgacatgagaaaggtacaacatgatattccaggaaatcagaagagctaagtatatctgaacctttgagagtatggcctgtccatacaaaggcagaatctacatttgtcaagtgccttcaagaaacattctaccaagatatgcacctccacaa

SEQ ID NO: 407646 - DNA, 1458 bp, Homo sapiens
cagagtgagaggagcaaaggggactcggccgccatgttaggagtactgggacgattccgcggagccgggcagaggttttaggggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaaatgatcttctgtgtcatgtttctgggaacaagtcaagatgaatgagtttgatttttaagcagaagtagtatgtgttggtgtcatccatgaatacaacaatgaaaaaggctcaaagttgttgttattcagaaacttctctaagtaatggtggtaagtacaggaaaaggagcaatgtctaccattttctttctaaccttcgatttaactattgtaatgttgtaagcttaacagagacttacacttaggcttaatttcaagctcttcaatcatttttcccggttggtgattcaggtgtattctcatgtcttatgtaaacttatcatgagtgttgttgatttataatatatttctttatgtaagccatagccttgtcagtttgagttatatggaagacaaattgtagggaaaaagagcaacagattactcagaaaccttctgtgtgagctgggcatagtagtgcatgccagtaggcttagctacttgggaggctgaggcaggaggatcacttgatcccattagtttgaggctgcagtgagctatgattgtgtcactgtactccaatctggacaacagtgagactatgtctgtttttaaaaaagaaagaaagcttgtgtttgagaagtgatacctctagaatacagtgatttctataatttgtcatgtgtttgggtagtttgaagtttttctatccttgtatctaatggacatctgaccataaagatgaaaaaatcctgcactcattataaattttatttataaaattgatatttgaggagttggggaggccagcttctgaaaaaataacagtgtcccatagaaacaccacaacttaggaaaatattgttaaagtggaattaggaatatctagaggaggtaaagcttttcatctctc

SEQ ID NO: 407647 - DNA, 774 bp, Homo sapiens
cagagtgagaggagcaaaggggactcggccgccatgttaggagtactgggacgattccgcggagccgggcagaggttttaggggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaaaaaaaaaaaaaaaaaaaaaaaacaattttgggcgggtcggcaccggaaaaagtttttaacccttcggtggggcggcggcccaggtatggaccggccatcgcgggcaaggaacccggcacgcacagggggcttcccaaaaaaagcgggggaccgggtcgaacatccgggtcggctccggcttacagggccggctaccccgccggggggt

SEQ ID NO: 407648 - DNA, 881 bp, Homo sapiens
ggtctcagctcctgaaggggttgcatggggccctacgcttccttctccattttttagctaagagattgagagagtcggtttacttttgggcttggagtatcatttagatctgttaacagtacagttgagagagttggtgtcttttgttgaggtgcgaggacccgaggcggcgaccctcgcctttattcggagaagcccacttccacccacagagttggggtagtcctccgaaatgcatttttgttttgccgtttgttttccaaccccctttcactctccccaaagcttcagattcactgatttttcatacaggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccaggtgcggtcgctcacgcctttaatcccagcactttgggggcagacgcggggagatagcgtgattctaggagttcaaccccagcctgggcaacatgcggagaccccgtaccgtctctacaaaaacattaaacaaaaaaattagctgggcatggtggtgtacccctgtagttgcagctacactagaggctgaggtgggaggatcgcttgagcccgggatgttgaggctgcagtgagcctcgatcctaccactgtgctccagcctgggcgacagcaagcccgtgtctcagaaaaggcgggaggggtgggatattattgatgataggccttctgacgtctggcaatagattccagagtaacatcggtcatggataaattttttttttaacta

SEQ ID NO: 407649 - DNA, 649 bp, Homo sapiens
ggtctcagctcctgaaggggttgcatggggccctacgcttccttctccattttttagctaagagattgagagagtcggtttacttttgggcttggagtatcatttagatctgttaacagtacagttgagagagttggtgtcttttgttgaggtgcgaggacccgaggcggcgaccctcgcctttattcggagaagcccacttccacccacagagttggggtagtcctccgaaatgcatttttgttttgccgtttgttttccaaccccctttcactctccccaaagcttcagattcactgatttttcatacaggaatgattaacaaaggcgtccgaagaaatcgttgttggaaggtgaccaaggtggaaagagacgttgctttggccctgccacacttcagtgaattatcttgtatacctctagagtgagcacattccactttggagatcagtagtctcagcaacaagacctccagccctggcccataaaactttcctttccattcttcgtgctctcattcttccttcatctgccggaggattcagcagaaccattaggtgcacagagctcttctctcctcccactacttccaacgtgcattgaactgtgatgtgagccagaaataaactcttattgtgttaaatcatta

SEQ ID NO: 407650 - DNA, 389 bp, Homo sapiens
cagagtgagaggagcaaaggggactcggccgccatgttaggagtactgggacgattccgcggagccgggcagaggttttagggacggggttttcccatgttagccaggatggtcttgatctcctgacctcgtgatctgcccacctcggcctcccaaggtgctgggattacaggtgtgagccaccacgcccagcctaccttgctatagaatctttaggcctaatatagtctagccagaacagctatttggatgcttgcctaatcttcaatactggtttcccttttatacatgactgcaaaactgactctcacctaggtttgtgatgttagaaactccagttgtttactattattattaaagtgggaaacggagttcgttgatcaaatgga

SEQ ID NO: 407651 - DNA, 409 bp, Homo sapiens
cagagtgagaggagcaaaggggactcggccgccatgttaggagtactgggacgattccgcggagccgggcagaggttttaggggaatgattaacaaaggcgtccgaagaaatcgttgttggaaggtgaccaaggtggaaagagacgttgctttggccctgcaactcactttgaggccaagctgggattacaggtgtgagccaccacgcccagcctaccttgctatagaatctttaggcctaatatagtctagccagaacagctatttggatgcttgcctaatcttcaatactggtttcccttttatacatgactgcaaaactgactctcacctaggtttgtgatgttagaaactccagttgtttactattattattaaagtgggaaacggagttcgttgatcaaatgga

SEQ ID NO: 407652 - DNA, 318 bp, Homo sapiens
ggctaagcagtttaccaaagcattttcctttccctccttagcacacaggactatatttcctggcctcctttgcagttaggtgcagccacattactgtgttctagccattgaaatatggaaagaaatgatcaatactacctccagccctggcccataaaactttcctttccattcttcgtgctctcattcttccttcatctgccggaggattcagcagaaccattaggtgcacagagctcttctctcctcccactacttccaacgtgcattgaactgtgatgtgagccagaaataaactcttattgtgttaaatcatta

SEQ ID NO: 407653 - DNA, 285 bp, Homo sapiens
cagagtgagaggagcaaaggggactcggccgccatgttaggagtactgggacgattccgcggagccgggcagaggttttaggggaatgattaacaaaggcgtccgaagaaatcgttgttggaaggtgaccaaggtggaaagagacgttgctttggccctgcaactcactttgaggccaagcgtggttgctcaggcctgtaatcccagcactttgggaggccgaggcaggtggatcacctgaggtcaggagttggagaccagcctggccaacacgacaaaccccgt

SEQ ID NO: 407654 - DNA, 1495 bp, Homo sapiens
cagagtgagaggagcaaaggggactcggccgccatgttaggagtactgggacgattccgcggagccgggcagaggttttaggggggtgcgcaggagtcaagtggtggttcagtggggacggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaaatgatcttctgtgtcatgtttctgggaacaagtcaagatgaatgagtttgatttttaagcagaagtagtatgtgttggtgtcatccatgaatacaacaatgaaaaaggctcaaagttgttgttattcagaaacttctctaagtaatggtggtaagtacaggaaaaggagcaatgtctaccattttctttctaaccttcgatttaactattgtaatgttgtaagcttaacagagacttacacttaggcttaatttcaagctcttcaatcatttttcccggttggtgattcaggtgtattctcatgtcttatgtaaacttatcatgagtgttgttgatttataatatatttctttatgtaagccatagccttgtcagtttgagttatatggaagacaaattgtagggaaaaagagcaacagattactcagaaaccttctgtgtgagctgggcatagtagtgcatgccagtaggcttagctacttgggaggctgaggcaggaggatcacttgatcccattagtttgaggctgcagtgagctatgattgtgtcactgtactccaatctggacaacagtgagactatgtctgtttttaaaaaagaaagaaagcttgtgtttgagaagtgatacctctagaatacagtgatttctataatttgtcatgtgtttgggtagtttgaagtttttctatccttgtatctaatggacatctgaccataaagatgaaaaaatcctgcactcattataaattttatttataaaattgatatttgaggagttggggaggccagcttctgaaaaaataacagtgtcccatagaaacaccacaacttaggaaaatattgttaaagtggaattaggaatatctagaggaggtaaagcttttcatctctc

SEQ ID NO: 407655 - DNA, 1583 bp, Homo sapiens
ggtctcagctcctgaaggggttgcatggggccctacgcttccttctccattttttagctaagagattgagagagtcggtttacttttgggcttggagtatcatttagatctgttaacagtacagttgagagagttggtgtcttttgttgaggtgcgaggacccgaggcggcgaccctcgcctttattcggagaagcccacttccacccacagagttggggtagtcctccgaaatgcatttttgttttgccgtttgttttccaaccccctttcactctccccaaagcttcagattcactgatttttcatacaggaatgattaacaaaggcgtccgaagaaatcgttgttggaaggtgaccaaggtggaaagagacgttgctttggccctgcagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaaatgatcttctgtgtcatgtttctgggaacaagtcaagatgaatgagtttgatttttaagcagaagtagtatgtgttggtgtcatccatgaatacaacaatgaaaaaggctcaaagttgttgttattcagaaacttctctaagtaatggtggtaagtacaggaaaaggagcaatgtctaccattttctttctaaccttcgatttaactattgtaatgttgtaagcttaacagagacttacacttaggcttaatttcaagctcttcaatcatttttcccggttggtgattcaggtgtattctcatgtcttatgtaaacttatcatgagtgttgttgatttataatatatttctttatgtaagccatagccttgtcagtttgagttatatggaagacaaattgtagggaaaaagagcaacagattactcagaaaccttctgtgtgagctgggcatagtagtgcatgccagtaggcttagctacttgggaggctgaggcaggaggatcacttgatcccattagtttgaggctgcagtgagctatgattgtgtcactgtactccaatctggacaacagtgagactatgtctgtttttaaaaaagaaagaaagcttgtgtttgagaagtgatacctctagaatacagtgatttctataatttgtcatgtgtttgggtagtttgaagtttttctatccttgtatctaatggacatctgaccataaagatgaaaaaatcctgcactcattataaattttatttataaaattgatatttgaggagttggggaggccagcttctgaaaaaataacagtgtcccatagaaacaccacaacttaggaaaatattgttaaagtggaattaggaatatctagaggaggtaaagcttttcatctctc

SEQ ID NO: 407656 - DNA, 1061 bp, Homo sapiens
cagagtgagaggagcaaaggggactcggccgccatgttaggagtactgggacgattccgcggagccgggcagaggttttaggggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaaaaaaaaaaaaaaaaaaaaaaaaaaaaaaaaaaaaaaaaaaaaaaaaaaaaaaaaaaaaaaaaaacaaaacaaaaaaaaaaaaaacaaaaaacaaaaaacaccaacaaaaagcgacagccacaccacacacaaaaacgcagacccgcgagacaacgacacacgcgaagacacaacaactcacgaccacaaggcacacccccagaacagcgcccacagcacccccgacagccgccgcccaaccgcgacataagccccccacagccccaacgtaccacccacccatgaccacccacaccaccgcacgccccccacaccggcgcccgccacagcaccagagcacacccgccaccgcgcaacacacgcaaccccctcccgcccaccaactatacacaaagacgacactcagcacaccgacacaccgacacacaacccccgccgcaagcgcaccccagcccacctccactccacctccccagacccacccgaacacccggc

SEQ ID NO: 407657 - DNA, 696 bp, Homo sapiens
cagagtgagaggagcaaaggggactcggccgccatgttaggagtactgggacgattccgcggagccgggcagaggttttaggggggtgcgcaggagtcaagtggtggttcagtggggacggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtactcggcctcccaaggtgctgggattacaggtgtgagccaccacgcccagcctaccttgctatagaatctttaggcctaatatagtctagccagaacagctatttggatgcttgcctaatcttcaatactggtttcccttttatacatgactgcaaaactgactctcacctaggtttgtgatgttagaaactccagttgtttactattattattaaagtgggaaacggagttcgttgatcaaatgga

SEQ ID NO: 407658 - DNA, 993 bp, Homo sapiens
cagagtgagaggagcaaaggggactcggccgccatgttaggagtactgggacgattccgcggagccgggcagaggttttaggggggtgcgcaggagtcaagtggtggttcagtggggacggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtagtttggataattaagggagcactagaaaacttttttttttttttttgagatggagtctgttgcccaggctggagtacagtggtacggtctcgactcactgagccgggacctccggggctcaagtgatcttcctggcctcaaagcctcccaaagtgctcagattatagggtgtgagccaccacgcttgggccaccatctatttactttcggaaatcttcaaaagacttgcttactcaaggtcagctgatggtgggtaaaaataatgggccttagtggttaagtgagacatcataggggtatgaggtatacattatgggatgcgattgtcggtccgaactatgggagttattacatcctatcctggagttgaatactcaggtccccacgagaaagaaaggtcgtttcaggcccggctcttggctcactgcgagcaattcttcctccttaatttcgaaataaaaacctattggggtgaagaccccgttaatagggtcataagggggcatccagggggtggtataacatgggggcccttggagttcc

SEQ ID NO: 407659 - DNA, 524 bp, Homo sapiens
tttctgactctgctgagcgcagttttgtcatctgtgatacgggtgcataccaaccctgtggagctctctgaagctactcggaatgggtaatgtgccccaggcagggctcagctgggcaagtaggggagcaagagcagcctggggtggcccagggactggtggcccctgctggctggcacttggacccttggcaaggcagtccctaagctctcagttcctcctgccctggggcaggaggggaggcccctgggcagcagccagcagcatccccaaccacagattggggggctgcagtccaggagggtgggtgctgggcctgggccctgcagcagctcacaggactcagtgggggccccaaggaggtgaggaggctgcactcccactcccagaaagcagcagcccaccaagagggtgtgtgtgtgtgtcctagccttgttcccaaagatgtcagaggtgatctgcattcagacatcttataaattggtaaacacctgtaatcccgacagagcaagactccgtctcag

SEQ ID NO: 407660 - DNA, 819 bp, Homo sapiens
aggagagcctggcccgctcttgtagacccgtcagaagtgattgggcctattttagcccacagagccctcaggtgttcttcatgaaaccttcagggagggagtggccttgtaaaaatggtcgtaacctgaggcttgaaatgcttggaaggcttagaagtaacgggctgagcaggtaccgagaagctgaaaggatatcctctccttgcattgattttgatttccgtttgtgtgacttcctaactccacgttcagaatccagcacagggtgatgtagaacaagtcattgaggttttccaagtcccagatagctatgagaatcctgtcgttgcttctgttctctagactggctgactgtgcctccttcctttcccgcccttctatttcctgcctttggctgtttgtggttggaaggagaggaaagagagaaaaggagccggaacacacagccatggtgaggtttgggcttatctgggacttatgtgtgttctgttctcctcccttccttctggagtttggatcaatgaagcttgatggcccccagcagttcacagaaacgggcatttctctgtgaaattattacagtgtcagaatagaaaaataatttataagtaaagtacatcaaaggttttccgtggcgttttgcttacgtttctgtgtctattgggattgccaaacaaaaagaaagtcacggccgggcgtggtggctcacgcctgtaatcccagcactttgggaggccgaggcgggcggatcacgaggtcaggagatcgagaccatcctggttaacacggtgaaaccccgtctctactagaaatacagaa

SEQ ID NO: 407661 - DNA, 1570 bp, Homo sapiens
cgaatcgccgaagggcactgcttcgccgatttaaaaaacaaagcaaaaagccccgcatctgcatcaggaaggcgcctctgcctactctgggagagagaagggcacccctcccccttgctacgtagtcgtctgcggaggcacaaccgtggaaacgggagccgccaccaccaccaccgctcaaacctctcggcactggctggggtacagggagcggctgcgagcgaatgggataagcgagcctccagttccccgtcttccagagcaagtggcttcagtgatatccaagcgcccttccagcacccattccctgcctcgccagcaggcaccggggccccacttggcgtttgcggatttcagctgaatgggaggcgacacaatgagacaagagcaaaccgtttctcagcgttcttgcccagggccttcccgtctcgcggcccggcctccctcacccggaagtgctggtcccggtactggctcagctccacgtaggagtcgctgcgcagcgccttcaggaggccacccgacatagtgcagagaagcggaccacaatgcggcgactcccggcacgaggctgcgtccgcgatggcggaagcggaaacgcgcggaggcgagcatctcattggacccaatccgagggcggcgtgtcgtcatcaagctgcgcgggggcatagacgtccgggtcgggcgccgcggggcggaagacgagggcggcgaggtcgggttccgggcgcttggagaagatggtgctgcggcggctgctggccgccctgctgcacagcccgcagctggtggaacgtctgtcagagtcgcggcctatccgacgtgcggcgcagctcacggccttcgcactgctgcaggcccagctgcggggccaggacgcggccgccgcctgcaggacctcgcggctgggcccgtgggctccctgtgccgccgcgctgagcgatttagagacgccttcacccaggagctacgccgcggcctccgaggccgctcggggccaccaccaggtagccagaggggccctggcgcaaacatttaatcctgggctgtgcggggccgaggccgcttgcttttccttccgggctctacagtggcatcaatgtggaggggtcattccgggcactgcgcgcggcttcgaatcccgactgggattgttggcctgcagacatcccacgcataagagcctaggccagaccgcccgctccgttgaagtcttgtgattggacaagacacagtgtggagacagccctaagcctaacagagatgaaggtaggctgggtccagacacggcacctacggagagccacggaccgaagccagagagcctttcctctgcaagtgggactgaaactcttgacagatgctgctcaatctgactggtatagcaggacagttaattccagggacgatatggatgaaaagacaaccctacagctgccaaattcctttgattaaatgtgtgagctggttgataggcatgagtgtgatacttctcaggcaagatgtgttaagaataccggggactgtaggcctatggtaataataaacacgtattttatgaaatgaatct

SEQ ID NO: 407662 - DNA, 325 bp, Homo sapiens
ctaaagagccaagtctgggtgctgtcgtgagaaggaaacatgggtatggaagaggcacaacttgccgtctcaaggccctggtccaaaagtggcccatatcactcctgctcccagcccttagcagggacataggcacatggccatactccactgccagctgcaaagcaggctgggaacaaaatccttacaggcatttatgtgaccagcaatagctctgtgctatggagaaaagagaaaaggaattttgctgggacagctttcggtctctgctaaatttattgattgattttcaaattttttttagatatgaggtcttgctttgttg

SEQ ID NO: 407663 - DNA, 435 bp, Homo sapiens
gattttgatttttaaaactcactgagtagtgtagccaagctcataaatccaagtatttgttttgcagtaactgtgatctggaattttatgttaagttgtggggttgttttctgttggtttattcagatggatgtaatgctactctctgggtgttcaaggtctgcctaggtgtggcaggggggcaaggccaagtggcaacttctgattccacatcctcgaagccagggaagaggcagtgctgtgcttcacggagcccacgtgggtatcagcaaccctgggacactggcaggcctgaagtgttaagaaatgtgaggagcggccgggcatggtggctgaagcctgtaatcccagcactttgggaggctgaggcaggcggatcacgaggtcaggagatcgagaccatcctggataacatggtgaaaccccgtctctact

SEQ ID NO: 407664 - DNA, 652 bp, Homo sapiens
taattgtggccttcacagagaagatgtttcattcatgaactcaggagctgaaggggtcttccctaaattcaggacaacattgagaacaaggccatgggggactgagccttggagtagaacagtgacatctgcacataagggatattgttaaggcccatgtggagaaaataaagctggcttcaagtgtctcaaggtacaagacatattttaatagagaaatgggcagtgcacattttgtaatgtttagtatctcctgtgttccttcctgtccctttattgagaataaggaatttttccattcagttttgcagtttataggctctcactcagggataatatgaaagcatacactcttgccagaaatttttaggtgtggacttggagactctgggtctgaaccaggtgacagcagtttacatcagacttggacaaagaacacctggcatttgttctgtcacagatatattacatgcatatatgctggagttccacactgaggccatctgaaagtttcaacgatgatggtggttcctaactgctaaatcatgaaaatctttgacataggacattctaccttgaatttatctgggtctctttccatataaactcattacttcaaagacgtctatctgctgaccagttggcagaagtt

SEQ ID NO: 407665 - DNA, 363 bp, Homo sapiens
gtgcatgacatggcattgggattggaacatgtggtttcgagcactgaaagctgcaaaccagtgaagaggaaaagaaccttgtgattaaatataaaaccaaaagtcaaatggtgctttgtgttttagccttcagtcaccatgactggtctctcccccagatgtatatataccatagcatttgtctacctgctgtcttttcttcaggacagatgttcaggaattatattgattgaatttagactctgtgcatgttcttatggattcagtaaccaggaggtgattgagatggtgagaaacggcagctcttaccatgctctgagactgcccacccagatgtacagcctaatgacaggtctggatagt

SEQ ID NO: 407666 - DNA, 296 bp, Homo sapiens
gtgcatgacatggcattgggattggaacatgtggtttcgagcactgaaagctgcaaaccagtgaagaggaaaagaaccttgtgattaaatataaaaccaaaagtcaaatggtgctttgtgttttagccttcagtcaccatgactggtctctcccccagatgtatatataccatagcatttgtctacctgctgtcttttcttcaggacagatgttcaggaattatattgattgaatttagactctgtgcatgttcttatggaaatgatgttcagaatccatgaagaaacttcaggcc

SEQ ID NO: 407667 - DNA, 359 bp, Homo sapiens
gatggagtctcgctctgtcgcccaggctgtagtacaatggtgcaatctccactcactgcaacccctcctcccaggttcaagcgattctgctgcctcagcctcccgagtagctgggattacaggcatgcaccaatgcgccaccatgcccggctaatttttgtatttttagtagagacagggtttcatcatgttggccagcctggtctcgaacacctgacctcaggtgatctgcctgcctcggcctcccaaagtgctgggattacaggcatgagccacgcgcccagcctgtcaaacttatttgaccacaacccatagcaagaaacattttaccttgtgctcaaatacacatatctgtaggc

SEQ ID NO: 407668 - DNA, 475 bp, Homo sapiens
gcctgtctaggtgatgctgttgttggattttgcccttgctattctccactgtactccaaagtttacttacagaaaagcatgggctgcgttaacaaagcatctcacgatcctacagcaaacactgtgggccaatttttaacttgttgcatgttatgctgtagtatccataggtagtttgttttcaaacaaagtacaggtgtgcatttctttaaaaaagcagttatgagtaatgtttaaactatccatagagctaggataggggtttactatttaatagctggcctgttgccagtgctcctttgaatatagagtactgctgcttaaagcaggaataacaaaagatgctgttttacataaggctactcaataccctgataaattactggtctactaaggtgaatctgtatctgaattttattttcaaagaggatgaaaagattgttttaatacatactgttttgacatttctaccaat

SEQ ID NO: 407669 - DNA, 449 bp, Homo sapiens
cccctacccactcacaggtcccagtgtgtgtttccctccctgtgtcctgtgttctcgttgttcagctcccacttataagtgagaacatgcggtgtttggttttctgttcctgtgttagtttgatgaggataacgccttccagctccatccatgtccctgcaaaggacatgatctcgttcctttctatgtcgagttacaaccatttttaaaagtggaactgcacaggattacctcagcctgctaagtccttccagctaggccgtccctgtgggtttaaacgcaatgtaaagaaagtggatgttaagtgttcttaccacaaaaatgataactatattagttaatgcatttgttagttagctagatttaaccatcccacagtgtattttatgtatttgtatttatatttcaaaacatcatattgtacataataaacacatcgatgttaaaaa

SEQ ID NO: 407670 - DNA, 1271 bp, Homo sapiens
tggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacact

SEQ ID NO: 407671 - DNA, 286 bp, Homo sapiens
ataagcgcacagaagtgttcccagcagcactattcacagcagccaaaaggcggaggagccacaggcttgtcagctgatgacagataaagaaagcatggcctgtcatcccagcactttgggaggccgaggtgggtggatcacctgaggttgggagttcaagaccagcctggccaacatggtgaaacccagtctctactaaaaatataaaaattagctgggtgtgatgatgagcgcctgtagtcccagctacttggaaggctgaggaacaagaatcgcttgaacccgg

SEQ ID NO: 407672 - DNA, 4920 bp, Homo sapiens
  misc_feature (1051)..(1051): n is a, c, g, or t
  misc_feature (1961)..(1961): n is a, c, g, or t
  misc_feature (2265)..(2265): n is a, c, g, or t
  misc_feature (2274)..(2274): n is a, c, g, or t
  misc_feature (2415)..(2415): n is a, c, g, or t
  misc_feature (3081)..(3081): n is a, c, g, or t
  misc_feature (3138)..(3138): n is a, c, g, or t
  misc_feature (3358)..(3358): n is a, c, g, or t
  misc_feature (4001)..(4001): n is a, c, g, or t
  misc_feature (4317)..(4317): n is a, c, g, or t
aaataaaagtaaaaagatttcaaaataattcagacataaaaggagtgacattctgatacatggatggagctggagaatattatgcttagtgaaataagccagatacaaccttttgtacaaaaatacaaaattgtatgatctcatttatatgaggtagttagaagaggcaactctatggagacagaaagtagaatagaggttaccagggctgtgaggggagaggtgaatggggagtttaatgaatacagagtttctgtttggaatggtgaaaaaattctggagatggataatagtgatggttgaacaatattttgaatatatttaatgccacagaattgtacacttaaaaatggttaaaatggtaaattttacacgatatgtatctgtatctatatatatctctctctatatctatatatcttaccagaatacaaaatttaataacacactccgaaaacctttacagatgaggaaactgaagaaaactgtctacaggggaggagttaagaatttgcccaggattattcagctgggaatttgcattcgggatccaaacttagttctgtttcactacatattatctactccatattatctgttctgtgttatctgctggctttctgggtgattaaagatatgtcagctccgagaagaatgagtttatttgaatcattcagaaagttacatttaaaagtaggtaattgtagtttgatggaaggtacagtgtgaaaccctagacagactaaaggttaactttgaggatttctttctcagccagagtggtaatagtatgcatttgagaggggaggagagtagagttctaaggatgtggtctttggagacagtttcttgggttccagtccctgagctaccaatttgtgtctggggtgttatcctcttgatgtcttagcatccctatctgtaaattggtgaggataatgataacatctgataaggtggttgtgaggattaaaggaattgatacatgtgaaatccttagaactgtacctggcaaaaagtgtttgataaatgattttcagttattgtgccnatattattttagagttgatgtactttctcattaatggaaccaaacacttctcaagttaaaattacgtgcttaggactggtaagttacaaaaatggtaccacacgttttatctatttcaatttagaaatgtctgttgattaaatgtgttcgctttaaactactgaaacaatgtagacatttataaaatgaaagcgtattgatccctgttatctcattcgctacctttaacggtttggtgtatattcttccccaaattttcaaatatattcatatatgaatatgtatttttacatacattttataaaaatgggaccaagttatttggttctaacatggcttttttttaaggtcaatacaaagatctgttttattaaaaaataattgatattcctttagggctcactatatgcttggtactcttctaagtcattattttatatagatactataatatcgagagatggagagattaagtaacaactagttagtggtagaggaaggattttaatttgggtacgttagcttcaaagtcctgatctcccagccagggatcatttttggtaaggcctgtgagctggaaacgttaacacttttaaaagagttgtaaaacaataccaccccacttccctgaagaacatataagggagactagataccgcctgccaagcctaaaatacttaccatgtggccctttacagagaaagtttgctgccccttgctctaagccatccagctgtacctctttggtgtaaggggggtgcatagtattccagtttatgaatgtgcattacgcagcaaaccaatctgttgtgattgacattgttttctctcctgaaaagaagtgaacatccttatgtatctttgaacatttgtgtgacaattttctatagagttggctctttcaagattntgaacatttctagttttaataggtgttgtcaagttatattaatttttagttaaaacaacaactgtattgaagtataatttacatacaataaaaagcacacatttgaagggtatgatttgaggagttttgacaaatgtatgcacctgcaccgctgcctggatcaagatctataatggttgccatcatctcagagtcctttcatcctcttttacagtcattctctcaacttttttttttttccctccaagatggagtcttgctctgtcacccaggctggagtgcaatggcatgatctcggctcacngcaacctcngcctcctgggttcaagcaattctcctgcctcagtctcccgagtagctgggattacaggcgtctgccaccacacccagctaatttttgtagttttaggcgagatctcagctcactgcaaccttgacctcctgggctcaatcnaacctctcacctcagcctcccaagtagctaggaccacaggcatgtaccaccatgcccagctaacatttattattaatatttttttgtagagatggggttttcctgtgtcgcccaggatggtttccaactcctgggctcaaatgattctgccttggcctcccaaagtgttgggattacaggcatgagccgcggcacctgacttgtagtaaactctctgaattaatattccattgtaggcatgtgctacagtttttaaattcatttacccatggatggacacataggactgttgtcagctgttgataaagctgctatcaccatttgtatgtctttcctggacatgttttagtggtaaatattgattttactttgtaagaaaccgttaaactcttttccaaaatagttgtaccattttaaattgaaagttacagttgtaactgtgcaggagttacagtttcttcacattttcattgacacttcgtgttgccagtcttttaaattttggccatcaaatgagtattaagtatctcattgtgggtttgtgtttctcagatgatcaatgatgttggaacatcttttcatatgcttattggccatttgtgtactttttttggttcaagccttttgtccctttaaaaaattggattgtttgtctggttgagtggnaagaggtctttatatgttctgggtacatagtcacattatctgtcagattgtgttgcnaatattttattgttcatttttgtttgattttgtgtatttttaatactataaagatcaagttaaaactttaatatgggaagcataatcagataaattatgtgaaacaaattgtccttaattcacgagtcatttaattagtgtaacaaaatgttatgcatttgcagaaacttgtaaactaaaaggatattattcatatgctgttaggtgtatggatgataantttttttaattaaactagttttgaaaattattgtatttagtaattctcttcattttgcataattcaaaccttttcatttattagtgagttaagccttaaattttttcttcaaaggataaatgagaatattaaaagtaaaaagtgaccttgatcttagaatggggtatgtagaaatgatgattgccaaacttagtttccctactttgacaatcaagtaaaattttttttttttttttttgagacggagtcttgctctgtcccccaggctggagtgcggtggcgcgatctcggctcactgcaagctctgcctcctgggttcacgctgttctcctgcctaagcctcccgtaaatttttttattatagaaatggatggcttttcagattatatatacttggtttctatacactattttatttttgtaaagtagcagttcttttgctcaacacctgaattgcccccacaataaatttttagtttttcttcaatattcaagtaatacataacttttccttttcctgtttaacaaagaaaaaaatatataaagcaagctgttggacctccattgggtgttgtttaccaccactgtaggtgatcgtggcattgtccacctcagtcttctcatggctgtggattcaagttangaaattcctgaaggtagcattccaggtagtctgtagaacagcccaaactctctgaattagtattatctctgataggtgttttttttttctttgcttttttatttgagacggggttttgctctgtcacccagcctggatttcagtggcacaatcttggcttactgcaacctccacctcctgggctgaaacaatcctcccacatcagtctcctgagtagctgggaccacaggcacatgccaccatgcccagctaattttttatatttttgttagagacagagtttcactatgttgcccaggttggtctcaagattccngagctcaagcgatgttcccatcttggcctcccaaagtgctgggattacaggcatgagccgctgtgcctggccctggtagttttcttcttatatctttctcctgttgatctcacttgattttcttactagtctacaggaaatttcacgtggagattctgtgcctgtcctctttctggaatatcttccttattttagcatctcaacatgctgttcagcttctggcttgaaaccacccctctcccatcccaaccaagttaagcagcttctttcctgcttagaagtaccataacatgtgtattaatcttttgtctttttctctctccttcccttcattttaagctcctttttattaatctgtagggcagagcttagaaaaaggtttttgtatattgtaagtactaataaaatatttgtgaagttgatttgggacttgggagacctctcttctgtaagcaactcaataaataattatttaagtaccatcctcacccagtgtactgttagctgctgttatgatattgattactgtaaaattttaaagtatatccttggtagactgttgatcaaagtcagaaagcttgagaaactctgaggcaaaaaaaa

SEQ ID NO: 407673 - DNA, 1675 bp, Homo sapiens
  misc_feature (1051)..(1051): n is a, c, g, or t
aaataaaagtaaaaagatttcaaaataattcagacataaaaggagtgacattctgatacatggatggagctggagaatattatgcttagtgaaataagccagatacaaccttttgtacaaaaatacaaaattgtatgatctcatttatatgaggtagttagaagaggcaactctatggagacagaaagtagaatagaggttaccagggctgtgaggggagaggtgaatggggagtttaatgaatacagagtttctgtttggaatggtgaaaaaattctggagatggataatagtgatggttgaacaatattttgaatatatttaatgccacagaattgtacacttaaaaatggttaaaatggtaaattttacacgatatgtatctgtatctatatatatctctctctatatctatatatcttaccagaatacaaaatttaataacacactccgaaaacctttacagatgaggaaactgaagaaaactgtctacaggggaggagttaagaatttgcccaggattattcagctgggaatttgcattcgggatccaaacttagttctgtttcactacatattatctactccatattatctgttctgtgttatctgctggctttctgggtgattaaagatatgtcagctccgagaagaatgagtttatttgaatcattcagaaagttacatttaaaagtaggtaattgtagtttgatggaaggtacagtgtgaaaccctagacagactaaaggttaactttgaggatttctttctcagccagagtggtaatagtatgcatttgagaggggaggagagtagagttctaaggatgtggtctttggagacagtttcttgggttccagtccctgagctaccaatttgtgtctggggtgttatcctcttgatgtcttagcatccctatctgtaaattggtgaggataatgataacatctgataaggtggttgtgaggattaaaggaattgatacatgtgaaatccttagaactgtacctggcaaaaagtgtttgataaatgattttcagttattgtgccnatattattttagagttgatgtactttctcattaatggaaccaaacacttctcaagttaaaattacgtgcttaggactggtaagttacaaaaatggtaccacacgttttatctatttcaatttagaaatgtctgttgattaaatgtgttcgctttaaactactgaaacaatgtagacatttataaaatgaaagcgtattgatccctgttatctcattcgctacctttaacggtttggtgtatattcttccccaaattttcaaatatattcatatatgaatatgtatttttacatacattttataaaaatgggaccaagttatttggttctaacatggcttttttttaaggtcaatacaaagatctgttttattaaaaaataattgatattcctttagggctcactatatgcttggtactcttctaagtcattattttatatagatactataatatcgagagatggagagattaagtaacaactagttagtggtagaggaaggattttaatttgggtggtcaccaactgccaaaatctgttcctggcattaagctccttcttcctttgcattcggtctttcttcagtggtcccatgaatgctttcttctcctccatggtctgtacg

SEQ ID NO: 407674 - DNA, 168 bp, Homo sapiens
cacacagagttaaatttatattttttaaaacaaagtctgaaattattcagtattccctatccttttttaacaaacaggaacttagcacactttagcttccctatgcatatcattactttattaaaaaatgggaaacaggtctgtactccctatctgtggcaatcaaga

SEQ ID NO: 407675 - DNA, 504 bp, Homo sapiens
ataaatggaaacagacctggcaagtaagacatctctgatttggaggatatattttttagtctacaaagaatccttgaatacatcaagatagagcatatcttacaaacatatgggcaaccatatgacatcatcctgtgtcactactagttttggtcatgtgaatccaaagggccctttggtgatgttactcaccaatacacttcccagtcatataaaattagataccttcccatccttaaccacttttagtagaaagaatgcccttcagtccacactgtgttactaggcccaaagcagtgttactagtagtctatttcttacagcatacaaaactgctctgtatcagtttgccagggctgtcataacaaagtaccacagactgtggcttaaacaacagaaataacaaagtagcacagactgtggcttaaacaacagaaatttattttccacaattctggaggccgaaagtctgagatcaaggaggcagcaaaggtggtttcttct

SEQ ID NO: 407676 - DNA, 504 bp, Homo sapiens
tcctgagctctgtctggctttttttgcggggaagagatggagattaatgaattgtctttgggcatgtttagtttcaggtacttggaaatacaggcttgcagtttagaaaacaacttacagctgtagataaacatttacgaattatcaacatttgaggtagtggcaagtaaatgatgtttttatagaattatcatgtagttaagaagaaaacagttttaaatattggaccatgggccagcatttaagagaaagttaaggaaaaaaaaaagatttaagaaaaagacacacagaaagtcatgccactgagattttactatgagtcccaggcaaaggttttaagatgagtgtatcaatgtcccctaggcataaaaaggattaaaaagagaagagttcagatgacaatttggaaggcactggtaaactttgagcagtttaattagattggtggagagttggagacgagacagagtccttgaactgataaacaaaaaaaatctgagagta

SEQ ID NO: 407677 - DNA, 607 bp, Homo sapiens
tcagcatggaaatggatataactttctgtgctcctctgcactcctaaaatagtctaatatgttccagatgagtttgcagctgagaactccctgcatcattccactgatggatgcacagggcatgattatgtaataatgtggacagctactgcaacatctagatcattgagggcagtgtagatgtggctgtgtgctaggacccttggtagctatccagaggactcagtctggtgtctttctgagtctctgtgagaggcctctaagccctgcttctccttgaaaatgattccctagacaccgaatgccttgtttgtatgagtgaataaatgctctgggctgctagagaaagcaataggaggagctgggaggaagagaatattcaggggcgcactttgctaccaaacaatttccatgtcagctgctaacattactgcctttttagcctatgaagtgtagggcaaggactttgacctgccaggtggggctggaaaggagcacatcagctccaggctaagaaatgggatagaaaagcaagaagagaggcctggctggctttggcgggggtgagtctcagctcctgagggtttgaacatgctctgtgcttgcc

SEQ ID NO: 407678 - DNA, 469 bp, Homo sapiens
gtgcgctctcattgtcaggggaccgctgtggggaaaggggtcggacagctctgcactgggcagttccctgctccctggaaggctttcccatgtttatatttttcttcccttctctgtgtaaacagccctgcttcctccaattgatcctgagtatttgataccatttccagacaccattctagtgaaggtgctctggtttccattgtccccgggaaatgtggcatccagagctgagcagagttacccagatgtcatgtgcctggtgcccgaacagaaggagtgttgtacctgtggcttagagttgaaatgcaaagtgagtgacttaagaattcactagatggaaaccccactgaagtggtgcgtgtctgtttcactgttttatcctcgttgacttatgggctcagtaactatttttaaaatgatggaatgattagatgaaagaggagatggaaaaaaacagagaaagcaa

SEQ ID NO: 407679 - DNA, 360 bp, Homo sapiens
aactttcaggaaatgaaactgtcagaaaactgccctaggtctattatcaatcagagcccctgtgagtggaagtcctcagattctggaatccatccagtgtctttcttttccttccattcatcctgacatgaataagcataacataactgtaagaaggagtgtagtgtcccagccctgacaacgagtaccgccagggacctaccatctaacaccatctgggaacactattttttctcagtccttccagttgacacaaggaaaccctttataaaataggacaaaattaggagattagtcccaagccaagaccaaaggtgaagataattgtgttagtgattaacgcctggtcttattttaacg

SEQ ID NO: 407680 - DNA, 334 bp, Homo sapiens
ctaatagggtaaaggagaagattgcctctaggatgagttcattcatgtgaaaagatcttgtaaagttaaaccataaaatgttccactgatgcattatcaatgatggctacagtaaatattaagacaagcttttacagctgtttcccaatcaataagatgtaagatgtaataaaacatagacctgacctgcattcccattaaattcatgaaagacattctgtgctactgatctggcagtgcctgcagcaggcccgccaaacagaaatatgtgcgtacttcaggaactgagcagcctgtgggtgatgtccaactagagcctctcactctgaattcc

SEQ ID NO: 407681 - DNA, 347 bp, Homo sapiens
tccaatcagaaccaggttgttgaaaggagcgtccacactacagctcgctcagaggttttggaattttctcgctgacattatgaaccgcaaaggtctttgcctaactctgtagaacctgttttcttgatttggctgttgggcgacaccagacgccttggactttccctaggaggcgtggggagtccctgggtctcctggttagggtcagtgacagggatgctcagagcacattcatggctcaccacagacaatgtgacccccaacactgctgcagaaagggtgccgcaagcgccccaggactgacctctcacatccatctcccaagcatgttgacagactatctggag

SEQ ID NO: 407682 - DNA, 264 bp, Homo sapiens
ccttatgaccctcccttacaaaatcagtaagaagaggatattgcggtagttggatgcacagagttttcatctatgttccaggattcagggggtctgtgatctaccagaaaaatgttttacaaacatttgtagatttagttttttgtgtagcgggcccattgcttacattagattctcaaagttgtctatgaccctaaaatattaagaccctttgtctaatggtttttttttttttctttttctttttcttttgagacggagctt

SEQ ID NO: 407683 - DNA, 452 bp, Homo sapiens
ttcccagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattct

SEQ ID NO: 407684 - DNA, 367 bp, Homo sapiens
ggatatgatacgctttctctcttctctttagggtaatgttcaattacactgcatatattttgctattatgtaggttttttttttttttccacatatactggctttacaaatgccatataattagtatggtaccaaattgttattacatttgaaatacgttaaaaagaatccaggagtcagggtgggtggggagacaactccagggacacaatacattgtgtcttgtattaaaaactagtgtgtgttggggtggggaacaggcaggaaactaatatgtttctgtttgatatatgaaaatatgcacaagctatcatgtttcatctcatatcaacaaaatgattataataaatcatactctagaaaactc

SEQ ID NO: 407685 - DNA, 2544 bp, Homo sapiens
agcggggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacggctactggcaggagcaggatttggagctgggaactctggctccactcgacgaggccatcagctccacagtctggagcagccctgacatgctggccagtcaagacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttcctcggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgc

SEQ ID NO: 407686 - DNA, 5361 bp, Homo sapiens
agcggggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttcctcggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcaccagacaccaccagaccaaattcactttccagccccttcatgttgaacctgaaacttgagctagtgtcttgggagaaaagggggaaatctctacgaggtacccatccttctgcaccttaggtctgaggtgcttggccccctaggaagccctacatgaatgggacagaaggtccttaacaacactggagatgaagcagccgatgctgttttggacaaatgaaacagcgtcccctaaccagccctttctatctcattgttctgacttggacacgccatggctcaccgctcccaaagtccccactatgtctccctagctgaggaaataaaagcagagaggggtgatgaaacagtgacgatcctggggaaacagctgaggaggggagggagggggaagaagccactaaaaaagtgaaatgtgcttgggagaatcggcctgcctgcagggtagatgccctttctctctgctggccagctctgcccctcagtgagaaactttacatattgctaagatgcctggccaatgaaacagttccagagactttatgtcccccagtagaaatatgaatagaaatcaccctgtgggcaatggtcccattttaaaatatgctgtcccattgtcccctagagcctactttaacttgtcagaccatgtattccacttcatatgcaagaggcatgcactgagcccataggtggctaggcaaacacccaatagctccctgaaatggcttcattatgcagcctcgacagccaccccaaccctcccactctcacactgaaacacccagacctagagatagctagacacacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagccctt

SEQ ID NO: 407687 - DNA, 2828 bp, Homo sapiens
  misc_feature (2808)..(2808): n is a, c, g, or t
agcggggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttcctcggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagccagnctaagttcagagccagggta

SEQ ID NO: 407688 - DNA, 5327 bp, Homo sapiens
gtgagctcaatatgtgacaagttcaactttatttgttctgtaaaaaatatgtattaggtctttcctatgtgctaggaggtttgctaggcacaggtaaaccactcatttcccttctcagctttctgttaagacatctcttagggcccaccaaggacagaccttccagaatcctatcacacaaggttgcaagagaagttgctcacatattcaatagcaataatggtccttgttcatgagaagtaggagaaggaaggtctttgttgcacttcttgagctgcggaaacatttagaggtagaagctgtagtgtgcaactaagtgagggaatctcctaagccgtgtggggaggtattcattgataccatttccttctccacagacacaccaactgcgatgattaggccagaccctccccatcctcgtgagggccagaagctgttgctacactgtgagggtcgcggcaatccagtgtaagaagatccatttcctggtctcctccttactctccacattctcagattgccttcttcacataacagctccttcctatctcctctgtattgtctgacctgagcctctcatttccctgactgtccaataatgtccgcctgcaattagttcttctgcaaagcagcacaaatgggaaggggccactccctaactcagtccctgagtttcccacaaaggccaagttaaagtaagatacaagtctggagatctacagcttccccagaacgaaccccaagaggccacctggcgtatagcagctccagtgtctctggccccgataatttctccagcctcatcaaacagtccttgacatccctgctcccagttatttttttttttcttttagctccctggcctatgctctcctgagctcttctgatttgtctgcctcgacagcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttcctcggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcaccagacaccaccagaccaaattcactttccagccccttcatgttgaacctgaaacttgagctagtgtcttgggagaaaagggggaaatctctacgaggtacccatccttctgcaccttaggtctgaggtgcttggccccctaggaagccctacatgaatgggacagaaggtccttaacaacactggagatgaagcagccgatgctgttttggacaaatgaaacagcgtcccctaaccagccctttctatctcattgttctgacttggacacgccatggctcaccgctcccaaagtccccactatgtctccctagctgaggaaataaaagcagagaggggtgatgaaacagtgacgatcctggggaaacagctgaggaggggagggagggggaagaagccactaaaaaagtgaaatgtgcttgggagaatcggcctgcctgcagggtagatgccctttctctctgctggccagctctgcccctcagtgagaaactttacatattgctaagatgcctggccaatgaaacagttccagagactttatgtcccccagtagaaatatgaatagaaatcaccctgtgggcaatggtcccattttaaaatatgctgtcccattgtcccctagagcctactttaacttgtcagaccatgtattccacttcatatgcaagaggcatgcactgagcccataggtggctaggcaaacacccaatagctccctgaaatggcttcattatgcagcctcgacagccaccccaaccctcccactctcacactgaaacacccagacctagagatagctagacacacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagccctt

SEQ ID NO: 407689 - DNA, 4755 bp, Homo sapiens
catcatcgtggttataaatcttatagaatcgtcagtctacagagagcaagcgagcggaatgacaaaccacgagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttcctcggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcaccagacaccaccagaccaaattcactttccagccccttcatgttgaacctgaaacttgagctagtgtcttgggagaaaagggggaaatctctacgaggtacccatccttctgcaccttaggtctgaggtgcttggccccctaggaagccctacatgaatgggacagaaggtccttaacaacactggagatgaagcagccgatgctgttttggacaaatgaaacagcgtcccctaaccagccctttctatctcattgttctgacttggacacgccatggctcaccgctcccaaagtccccactatgtctccctagctgaggaaataaaagcagagaggggtgatgaaacagtgacgatcctggggaaacagctgaggaggggagggagggggaagaagccactaaaaaagtgaaatgtgcttgggagaatcggcctgcctgcagggtagatgccctttctctctgctggccagctctgcccctcagtgagaaactttacatattgctaagatgcctggccaatgaaacagttccagagactttatgtcccccagtagaaatatgaatagaaatcaccctgtgggcaatggtcccattttaaaatatgctgtcccattgtcccctagagcctactttaacttgtcagaccatgtattccacttcatatgcaagaggcatgcactgagcccataggtggctaggcaaacacccaatagctccctgaaatggcttcattatgcagcctcgacagccaccccaaccctcccactctcacactgaaacacccagacctagagatagctagacacacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagccctt

SEQ ID NO: 407690 - DNA, 4042 bp, Homo sapiens
acacacacacgcatgcgtgcaagcgcacacacacacacacacacacacacacacttctctttcttgctttgtattatagatgagattctacttaggggtaggattcattattcatgaagggtgtggtcaggtgaggcatgttggaagcaaaatgcgaattaggtaaggtggagtagaagagagctattggcaagagaaaaattacttgagcagtgtgtgagtgggtgggtgagaaagtgggcagggtggactcagaggttgggaagctgctcctgagaggagaagcctctgtctctacacaggaacctacctgacacatgaggcaaaaggctccgacgatgctccagacgcggacacggccatcatcaatgcagaaggcgggcagtcaggaggggacgacaagaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcaccagacaccaccagaccaaattcactttccagccccttcatgttgaacctgaaacttgagctagtgtcttgggagaaaagggggaaatctctacgaggtacccatccttctgcaccttaggtctgaggtgcttggccccctaggaagccctacatgaatgggacagaaggtccttaacaacactggagatgaagcagccgatgctgttttggacaaatgaaacagcgtcccctaaccagccctttctatctcattgttctgacttggacacgccatggctcaccgctcccaaagtccccactatgtctccctagctgaggaaataaaagcagagaggggtgatgaaacagtgacgatcctggggaaacagctgaggaggggagggagggggaagaagccactaaaaaagtgaaatgtgcttgggagaatcggcctgcctgcagggtagatgccctttctctctgctggccagctctgcccctcagtgagaaactttacatattgctaagatgcctggccaatgaaacagttccagagactttatgtcccccagtagaaatatgaatagaaatcaccctgtgggcaatggtcccattttaaaatatgctgtcccattgtcccctagagcctactttaacttgtcagaccatgtattccacttcatatgcaagaggcatgcactgagcccataggtggctaggcaaacacccaatagctccctgaaatggcttcattatgcagcctcgacagccaccccaaccctcccactctcacactgaaacacccagacctagagatagctagacacacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagccctt

SEQ ID NO: 407691 - DNA, 4880 bp, Homo sapiens
agcggggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttcctcggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcaccagacaccaccagaccaaattcactttccagccccttcatgttgaacctgaaacttgagctagtgtcttgggagaaaagggggaaatctctacgaggtacccatccttctgcaccttaggtctgaggtgcttggccccctaggaagccctacatgaatgggacagaaggtccttaacaacactggagatgaagcagccgatgctgttttggacaaatgaaacagcgtcccctaaccagccctttctatctcattgttctgacttggacacgccatggctcaccgctcccaaagtccccactatgtctccctagctgaggaaataaaagcagagaggggtgatgaaacagtgacgatcctggggaaacagctgaggaggggagggagggggaagaagccactaaaaaagtgaaatgtgcttgggagaatcggcctgcctgcagggtagatgccctttctctctgctggccagctctgcccctcagtgagaaactttacatattgctaagatgcctggccaatgaaacagttccagagactttatgtcccccagtagaaatatgaatagaaatcaccctgtgggcaatggtcccattttaaaatatgctgtcccattgtcccctagagcctactttaacttgtcagaccatgtattccacttcatatgcaagaggcatgcactgagcccataggtggctaggcaaacacccaatagctccctgaaatggcttcattatgcagcctcgacagccaccccaaccctcccactctcacactgaaacacccagacctagagatagctagacacacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagccctt

SEQ ID NO: 407692 - DNA, 5797 bp, Homo sapiens
agcggggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagtgtaagaagatccatttcctggtctcctccttactctccacattctcagattgccttcttcacataacagctccttcctatctcctctgtattgtctgacctgagcctctcatttccctgactgtccaataatgtccgcctgcaattagttcttctgcaaagcagcacaaatgggaaggggccactccctaactcagtccctgagtttcccacaaaggccaagttaaagtaagatacaagtctggagatctacagcttccccagaacgaaccccaagaggccacctggcgtatagcagctccagtgtctctggccccgataatttctccagcctcatcaaacagtccttgacatccctgctcccagttatttttttttttcttttagctccctggcctatgctctcctgagctcttctgatttgtctgcctcgacagcccccagcagtacctatgggagaaggagggcagtgtgccacccctgaagatgacccaggagagtgccctgatcttccctttcctcaacaagagtgacagtggcacctacggctgcacagccaccagcaacatgggcagctacaaggcctactacaccctcaatgttaatgaccccagtccggtgccctcctcctccagcacctaccacgccatcatcggtgggatcgtggctttcattgtcttcctgctgctcatcatgctcatcttcctcggccactacttgatccggcacaaaggaacctacctgacacatgaggcaaaaggctccgacgatgctccagacgcggacacggccatcatcaatgcagaaggcgggcagtcaggaggggacgacaagaaggaatatttcatctagaggcgcctgcccacttcctgcgccccccaggggccctgtggggactgctggggccgtcaccaacccggacttgtacagagcaaccgcagggccgcccctcccgcttgctccccagcccacccacccccctgtacagaatgtctgctttgggtgcggttttgtactcggtttggaatggggagggaggagggcggggggaggggagggttgccctcagccctttccgtggcttctctgcatttgggttattattatttttgtaacaatcccaaatcaaatctgtctccaggctggagaggcaggagccctggggtgagaaaagcaaaaaacaaacaaaaaacaaaaccctggagtgttaggaggagagtgaaggtagaggggtgaggaagggtaaggggcagggctggtttcagctgggggctctcaccagccctcctttcagcctctacaacagagcagcttcccagacttctccaggaacccagaaacgggatggttgtcggcaaaggttgggagtggcttttcctctggtagccacacacctgagcactacggacagggaggcaggtgccaccttgacacctctcttccatagcaatgggaaagtgatgagtgcgggagtcctgaggagatgtggcctgcagacaacatgcagccatgcagggacccaggactgtaacctggggaggacgcgggtccctgcaaggaagagtagatttggagaggaaggatggaggtggactctcaccccattccccccggaaatgaacaaagccgggccctttccataggaactgcccttggagatagcagagtgtggctgcccctccttgctccagcagcagtgggagaggcactgctctggggcctgaactgcctctgcttccccccctgaggggcccctcactcttacccaagactctggattgttgcacggcaaccactcctcccatggcattgctcagcaactacttctcccttcccggccaccctgtgcccccttcctggtcccaacgccagcccttcatccttcctccctcagcagccaggcagacataacaacaaaactactaaaaggagcttcactgcagtgagctgtttcctgcccaaactaagggaataatgtgaactgtgtgcatgtgtgtggtgtgtatgcatgtgtgcatgtgtgtgtgtgtgtgtgcatgtgtgtgagtgagtgagaggcagagcgaggaactgaggaggagggctaagagccaggggtcctgggcaagtggacagggctgtgggacatgttggggaggctttgggaatggggtattcctagtcagggttcacacctcacctgggatgttgttccatgctggtatttcctctgccacccccaatgcccatcggtcttggagaaaggagtccccgggtgtgtgtttgcccagctgtccattctatctctcccttaaacacagagcattcagcccttccctggatttccctcctctgagccatggagtcagtgccacagcctttgctatgcacctctcaggcctctccttggcgttgaccctggaaagacctaccaccacctattttttcccatagtctgtacccagtgagttgaaggctgggtccccacccttccttttgatttcctgtcttccttctcgtggccccagctggttgctgtggagatgaggttcctggtcctccctgtcctggctggactgccccgcctcagatccaggatgcccttggcatcgctcccaccctcccccagcttttcctccctggtctgacaatgggcatgcaaaaaggggcagctgcaatctagcaggcctgcccacccccttcagttcaggtaatacagttgtgaatcttccagccgctggttagggccttgggcaccacaggcagcccctcacctaagccggggcctactcctcttacaacagcaagagagccctggggccccaggcctgttgagcttcttgtctcccagcacccgcttttgggaaaatgacttttcctcttcaagctgaaccactctgtccatattacacagaagccatatttgtacgggggggtgggagggagaggggctgttgtgctgtgtgtgtctgtccaggggtgggggggtgggggaagggagcagggaggggaccgtgtatctttataatctttctaactctcctgtgctaatctcagaggggtcaccctcaatatatctggattatccgtgtcattcagctgcctcctttctggtcctcttgctgctgctgggatgtgtgtatgtgagggtcttcttcccataccccttgcacctggtgcctggtgcctcaaaaggtggtgtgtcccttgccaggccactctcaagaatatctatgtacagcaacaatataactctacaagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcaccagacaccaccagaccaaattcactttccagccccttcatgttgaacctgaaacttgagctagtgtcttgggagaaaagggggaaatctctacgaggtacccatccttctgcaccttaggtctgaggtgcttggccccctaggaagccctacatgaatgggacagaaggtccttaacaacactggagatgaagcagccgatgctgttttggacaaatgaaacagcgtcccctaaccagccctttctatctcattgttctgacttggacacgccatggctcaccgctcccaaagtccccactatgtctccctagctgaggaaataaaagcagagaggggtgatgaaacagtgacgatcctggggaaacagctgaggaggggagggagggggaagaagccactaaaaaagtgaaatgtgcttgggagaatcggcctgcctgcagggtagatgccctttctctctgctggccagctctgcccctcagtgagaaactttacatattgctaagatgcctggccaatgaaacagttccagagactttatgtcccccagtagaaatatgaatagaaatcaccctgtgggcaatggtcccattttaaaatatgctgtcccattgtcccctagagcctactttaacttgtcagaccatgtattccacttcatatgcaagaggcatgcactgagcccataggtggctaggcaaacacccaatagctccctgaaatggcttcattatgcagcctcgacagccaccccaaccctcccactctcacactgaaacacccagacctagagatagctagacacacccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagccctt

SEQ ID NO: 407693 - DNA, 969 bp, Homo sapiens
agcggggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccaagtccctcgtcactgtgctaggaattccacagaagcccatcatcactggttataaatcttcattacgggaaaaagacacagccaccctaaactgtcagtcttctgggagcaagcctgcagcccggctcacctggagaaagggtgaccaagaactccacggagaaccaacccgcatacaggaagatcccaatggtaaaaccttcactgtcagcagctcggtgacattccaggttacccgggaggatgatggggcgagcatcgtgtgctctgtgaaccatgaatctctaaagggagctgacagatccacctctcaacgcattgaagttttatacacaccaactgcgatgattaggccagaccctccccatcctcgtgagggccagaagctgttgctacactgtgagggtcgcggcaatccagttcgcccccgcgagggaccggctcgattcgta

SEQ ID NO: 407694 - DNA, 758 bp, Homo sapiens
atgcaatttccttttcaaaaccagcagcgggtttacaaatcaacaaaaaccacatcatatggccttgaaatgtgctgggttctgcactgtgtctaagaaaaggaaaagaaaaaaaaatggtattgtttcctgatgtcaagaaaagaagcgtgccctgccaatgaggaagtactgtgttgaaaacaaccagtggtcaagctggaaggtttgctagattaggattctgtaacaccctccaactgcgggctgctttgattgctggttctctgagtaacacttcacttgccttctgttagaatgttttaagttattttggcacttggtcaccctacttcagaaagactgtttggtcttttcatgaccatattggcagagtctaatgttatttgctttggattttgtgttatctgaaaagtctattatttttattagaaggtcatttttaaaaagaaagaaaaatatctccaaagtccttcgcaagacatatttccaaaatgaacagaaacactaacgtttatttttttaaaaaggagaaaaaaatctagtaatgggaaaactcctctagaaggacattaatatgggtaggaacatggtcaaagtgccttaaaatatttagcaacctctccttgccaccataacttaacgtctctctcaatgaatgggttatagctgttaaattctgtattaatggagactttttttttaccacttaattataaatgaacacatttcattttcagtgtagaacgtagatatca

SEQ ID NO: 407695 - DNA, 2395 bp, Homo sapiens
acaagcagaagtcaattgtccggtcccacttacaactcatcaaagctgtgagccagttaatagccgatgctgggattggaggctctcggtttcaacattcgcttgcaattaccaataatttcgccaatggagataagcaaatgaaaaacagcaatttcccagcagaggtgaaggacctgactaagcgtataaggactgttttgatggccacagctcagatgaaggagcacgagaaggaccccgagatgctggtggatctccagtacagcctggcaaactcctacgcaagcactcctgaactacgcaggacctggctggaaagtatggccaagattcatgccagaaacggagatttatctgaggctgccatgtgttacatccatattgctgctctcattgcagagtatctgaaaagaaagggttactggaaagtggaaaagatttgcacagcatccctgctctcggaggatacccacccctgtgatagcaactcattactaacaactcccagtggaggaagcatgttctctatgggatggccagcttttttgagcattacaccaaacattaaggaagaaggagcgatgaaagaggattctggaatgcaagatacaccatacaatgagaatatcctggtggagcagctatacatgtgtgtggagtttctctggaagtctgagcgatatgaactcattgctgatgtcaacaagcccatcattgctgtctttgagaaacaacgagacttcaaaaaattgtcagatctctactacgacattcatcggtcatatctgaaagtggcagaggtggtgaattcggagaagcggctgtttggtcgctactatcgtgtggcattttatgggcagggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttact

SEQ ID NO: 407696 - DNA, 1593 bp, Homo sapiens
acacctacgtgtgaataccagaaccagaaaaaaaattttttaaaaaaaaaaattcttttcttggggaaaatgaaaggggaaatttgggatttttctcttttaattaaaaaaaaaaaaaaaaaaaaaaagatagaaagaaaaaagaaaaaaattctaaaggcctaaaacagccctgagaatgagggcctgttagcagtgaaggcagaagggcacacaggtcaaaggagcttgggcacaagctaagaggtattagagaggatggcacctagcagaaaaagtaactcccatgcatgaaaagcatgcagaatggaaggtgccatgtgccgtgaaatgatacatgatcctctggtccttcagggaaacccttgactcttcactaatcctcaaccttgaaatccctttgtatggcttttgtacagcgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttact

SEQ ID NO: 407697 - DNA, 2061 bp, Homo sapiens
tgtgaagattgccaagtcatgcagaacgaattatctgagctgcatgtgtacatcatatgctgctctcatgcagagtatctgaagaagttactggaaagtggaaaagatttgcacagcatccctgctctcggaggatacccacccctgtgatagcaactcattactaacaactcccagtggaggaagcatgttctctatgggatggccagcttttttgagcattacaccaaacattaaggaagaaggagcgatgaaagaggattctggaatgcaagatacaccatacaatgagaatatcctggtggagcagctatacatgtgtgtggagtttctctggaagtctgagcgatatgaactcattgctgatgtcaacaagcccatcattgctgtctttgagaaacaacgagacttcaaaaaattgtcagatctctactacgacattcatcggtcatatctgaaagtggcagaggtggtgaattcggagaagcggctgtttggtcgctactatcgtgtggcattttatgggcagggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttact

SEQ ID NO: 407698 - DNA, 2742 bp, Homo sapiens
acaagcagaagtcaattgtccggtcccacttacaactcatcaaagctgtgagccagttaatagccgatgctgggattggaggctctcggtttcaacattcgcttgcaattaccaataatttcgccaatggagataagcaaatgaaaaacagcaatttcccagcagaggtgaaggacctgactaagcgtataaggactgttttgatggccacagctcagatgaaggagcacgagaaggaccccgagatgctggtggatctccagtacagcctggcaaactcctacgcaagcactcctgaactacgcaggacctggctggaaagtatggccaagattcatgccagaaacggagatttatctgaggctgccatgtgttacatccatattgctgctctcattgcagagtatctgaaaagaaagggttactggaaagtggaaaagatttgcacagcatccctgctctcggaggatacccacccctgtgatagcaactcattactaacaactcccagtggaggaagcatgttctctatgggatggccagcttttttgagcattacaccaaacattaaggaagaaggagcgatgaaagaggattctggaatgcaagatacaccatacaatgagaatatcctggtggagcagctatacatgtgtgtggagtttctctggaagtctgagcgatatgaactcattgctgatgtcaacaagcccatcattgctgtctttgagaaacaacgagacttcaaaaaattgtcagatctctactacgacattcatcggtcatatctgaaagtggcagaggtggtgaattcggagaagcggctgtttggtcgctactatcgtgtggcattttatgggcagggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttactctcgtgccgaattcggcacgaggagttttgttctttgtaaccctctcatcatcgaggctatatattaatagacatggtattaagcccacacgaaacattcagaattagaattggattaagaagacgcgttttggcatcacgctgactactcctcatctccgtcctcggggagggcgatgccagcgtgggactctttggaaggcctatcaatcacaggtgcgctaaaatcaaaaggtgggtcagtaggttagtgagggaggcgcgaaaggagatgccagcgggtgttaggaaggatatggtcagaagagctctttgtctccatccacggggccgtctgctcagcccgt

SEQ ID NO: 407699 - DNA, 426 bp, Homo sapiens
ttaaacaaatagaatatattttattcataagaagatttttaaatagtaaaaataaaaatgaagtgctaatcaaaacagctaactataagttctttgctgtttccaaagagtctctgaaccagagactacaacaagcgagtatttttcaagctttaaaagttaatattacatgttagactcctaatagatacttacttcccattttcaaactgcattcagtatcatttgttttcctgatgactagaacatgtaactttcccacatagatgtaacacaggcaaaagacaagacaaatgcatgtaaaatacatttaatagtttaatgggaaagtacagtccaaaaattttaaacttactgttcatggaaatccagcattggtggctcaaatcgtatgggcctgcaattcccccggtagagagatatact

SEQ ID NO: 407700 - DNA, 1177 bp, Homo sapiens
tttgccaactgatgttccttaatggcagcaggcttctcagaaaaaatggaaaattaataattctatatagcaagttctacatatcatcactctattctctaatacttagtgtttaatgtacataaagagtagccaattgtgatattaacaaacttattaacacctgttgacaaagatctttgaagacaaatctacacgcaagcttttgccttagcgaacaacaggaatagtttccttaaaaggatacagctattttgaaatttcctcaaccattgcatcccagtgggggggatacttacatggtaggactgtttggccaaagtgcttgaagcattaggacacaacaaagatagttttgaaatgttttcttgctcaaaatacatttgttcttaggacacggctagtgctcattttacattccatgcctgaagtgtttaaaacactgtggtacaggtttctgattctgtgttggtcaattttgaaatccatgtgttagtagtaagtgtgctgattcgtagagtgggtaacttctgggaactcccctttcttttattgacaatttctttgtaaagcaaatgctaattctacaggctattaataaagactggaactcccttgttcattagacacgcagtaggaaaatgggtaacatagctgtagaaatatatttgcaatatgttctcttcgcacaatttgcatataaatgccgctttccctatttactcaaattagcaatgtgtaatggagcactcatagcctttttgtaggttcctgtgacctttaattggcactcatttcagacaattgccattttagacattgctatcgccatcttttgcaattaagtttcaaagttatcatcatggcatttttaatatttagaaatttctttttttatctctggctttcagttgaagactattcaccccggtggactcatcatgttggggactttcaattgctactttaaaaagaacgcttcactgaaataggtctcatcccatcaggaacatagaaaaacaagcagcaggccgggcgcggcggcacaggcctataatcccagctacttgggaggctgaggcagaagaatcgcttgaacccaggaggcggaggttgcagtgagccgagatcgcgccactgcactccagcctgggcgacagagagagactctgtctca

SEQ ID NO: 407701 - DNA, 314 bp, Homo sapiens
gaggacctaagagtaagcattgggatgttccaaacaagggggtcggggagaagaggaggaaacaacaaaggaatagccagggaagtagaaggaaaaccaaaaggctgtggtgtcctttaaaagccaagggagaaatggtcaaattacatgaagtgctgctcataaataagatgaggaatgaaaggctagccactgcacccagcctacaataagtattttaaataaggaaatgaatctgaatgtctgcaaaaggttaccgaagcagagatgtaataattttcatttttaaaattaggataccagaatctcttgat

SEQ ID NO: 407702 - DNA, 464 bp, Homo sapiens
aaactcaaccctaagctctttaagggtgcaagtgtcatcttgggtttctgcgtctcctgacttcctccccaggcctggtgcagaagcactggcaatgcgtcttatgctgggcagacggtgcccagcaaagttgaatagatatgtggcaacaggctggctcagctggagtttcaccctcagtagggaggaacacataactccttcttgctgtggtatgggagtcccagggtctcaggacagtagaggccactggtccacacatgtcttctatgttcagtttgatctgaatttgagattagcgattctctttctcctctccctagtgggagaacaacaggagctgggctttggctgtagcagcagaggtcccagttagactcaaggaataactttccaagtagcagagactgtggaccatttgccagattggatttcagtgattggttttagactaagaggacttt

SEQ ID NO: 407703 - DNA, 127 bp, Homo sapiens
aaagcaccatgcacatatatttttggaaggaaagtccaggaaagctctggagaggagtggcatgcagaggttgcatggaacatttcccccctttgtattttaacagcacccaaaactcccctgggga

SEQ ID NO: 407704 - DNA, 539 bp, Homo sapiens
atttgccaggagttgtggtgcatgcctgtagtcccagctactcgggaagctcaggtgagtggatcacctgagcctgggaggtcaaggctgcagtgagctgtgatcgtgccactgtactccagcctaggcaatggagtgagacccagtctcaaaaaaacaaagagttgggggtggtgaatgaaatactaatgcatgctatattgtaaatgaacattgaaaataccatgctaagtgaaagaagccagtcacaaaagacaacatatggtagtcatattccatttatatgaaatttccatactaggcaaatctatagaggtagaaagtagattagtggttgcttaggactagaaggaagttggggagatatgaggatgagtgtaaaaggtacaggatttctttttgaggtgataaaaatgatctaaatttgactgtggttgcacatatctgtgaatatactaaaaaccactgatttgtacactttacatgggtgagttgtatggtgtgtgaattatatttcaataaagctgggttgttttttg

SEQ ID NO: 407705 - DNA, 147 bp, Homo sapiens
tgatttacatttcatactgacaagaattagtctttcttcagcactttggtttttttttctcttttgctcctgaaacttttgtatgctctgagataatttttctttgctcatccgtaagagagaaacctacaggcacttttgaggtat

SEQ ID NO: 407706 - DNA, 1342 bp, Homo sapiens
ccgtaggaggccaggatgacggcaaacggcagcagcaggatgaccacgcgggcggcgaacatctggttctcggtagtgtctccgtcgcctccgcaggccagcttgagcaacgccggcagctcacagatgaagtggtccagcaggcggggcgcgcacagcggccgctcagccaggagcgcggtttgcgcaaccgagttggtgaggccgcttagccaggaggcgctggccagcgtgcgacataggcgcggggagacgagccccgcatagcgcagcgggcggcacactgcggccgcgcggtccagagccatcaccgccaggaggacgcattcggccgaacccagagccagcgatgcgcacagctgggccgtgcagtggctgcgcggcagccagagcgctggtccgcgcaggttggccagcagcggcggcaccacgctagtagtgaagcccgcgtctaccaaggccaggtggcagaggaagtagtacatgggcgtgtgcaggcgcgggtcgcgcaccgccagcagcaccagcgccgagttgcccgtcaaggtcaggaggtagcacaggaggacaagggcgaagaggaccggctgcagggaaggccagtcggagaaacccagcaggagaaagcgctcctctgcgctgtagttggcctaaaggaggaaaactcccagaatgtttggaaggtcgaaataaaaaagggtgactaccccttataagcaaagggaaaaccttggagtgtggggctgggctgggagaaggaatggaatcatatacaaggtcagtttgtggattgtaatcccatttacagatgagattacttaaaaataaactccctaagaataagagcaacactccaagcttggcgtggccaacactcggtaggcagaatgatcacctccgttgtttcaggtactctgtgtttatttatgcaacagttcatgtaaaatggagacgaggccagaagaatccttgagcagacagagccagttgggcctcctaagtgaccttaaccttgcttgatttgcaagcatgtctgaaactttatttgtggtatttcttgtaaatgcctatgttaaagaaacacagaacttaagctcaaccaatcagaagcagccaacaaaaacgtaattagtaactaggacttcctcatgggatagaccaaataaggcaactgtataactgtgtaactgtataactgtaaccaatgaaatattatctttgcttttatctatttgtcctaaaaagcctcctcctcatgttctctctggggagctccctagccacttctggcttggagctgcccaattcatggatcactgctcaaataaactcttaaatattt

SEQ ID NO: 407707 - DNA, 679 bp, Homo sapiens
ccgtaggaggccaggatgacggcaaacggcagcagcaggatgaccacgcgggcggcgaacatctggttctcggtagtgtctccgtcgcctccgcaggccagcttgagcaacgccggcagctcacagatgaagtggtccagcaggcggggcgcgcacagcggccgctcagccaggagcgcggtttgcgcaaccgagttggtgaggccgcttagccaggaggcgctggccagcgtgcgacataggcgcggggagacgagccccgcatagcgcagcgggcggcacactgcggccgcgcggtccagagccatcaccgccaggaggacgcattcggccgaacccagagccagcgatgcgcacagctgggccgtgcagtggctgcgcggcagccagagcgctggtccgcgcaggttggccagcagcggcggcaccacgctagtagtgaagcccgcgtctaccaaggccaggtggcagaggaagtagtacatgggcgtgtgcaggcgcgggtcgcgcaccgccagcagcaccagcgccgagttgcccgtcaaggtcaggaggtagcacaggaggacaagggcgaagaggaccggctgcagggaaggccagtcggagaaacccagcaggagaaagcgctcctctgcgctgtagttgcctgaggaaactttcactggttggaggttct

SEQ ID NO: 407708 - DNA, 116 bp, Homo sapiens
aattcaagcttctaacgatgtacggggacatgttctctctggggagctccctagccacttctggcttggagctgcccaattcatggatcactgctcaaataaactcttaaatattt

SEQ ID NO: 407709 - DNA, 769 bp, Homo sapiens
ggcgcaggtcccgcccctttccatctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggaggtgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccactgcaggatatggagcccaacccgtaggaaatgaagcggccgcctgtgggatacagagcctcacctgtgcgatatggagccccacctcttggatacggagccccacctgcaggatatggagccccacctctaggatatgg

SEQ ID NO: 407710 - DNA, 837 bp, Homo sapiens
ggcgcaggtcccgcccctttccatctacggggcggcaggaggcccgaagcaagatggcggtgaatcagagccacaccgagaaccgccgcggagccctcatccctaacggtgaaagacaagcacaaaagcaccacccatgcctctgagaacactggaccatgcacccttgaaaacagctttgcttccttcatcatgagtaatcttcctccagcagtcaaatgtgcctgtgtacatgatgtcagttcctttgcatcctgactgcatcatcatgtagcagcaaatggtgttaaatgaataggaagtcaacccagcaacggcagtgacagtctgtgcatcatccaactgatgacaatctccagctttgcccacatcagctgctacacgagtatgggcaaaatcaagagggtacacaaaacacaaggatgtggccccagtggcaccgcctgatgccagattccctgcaaagtagcgccaaaactgggatctcttgtccacaccatccaggaagatctgcttgtatttatctttgaaggtgggaaaacaaaaagaagtcatttgcttaaagcgcatgtgggagagcttggatttggatttgaacttaggtactgtgcataaactcctgtactccagctgtccctctagaaagaaaaggactctttctctgttttcttctcaccaaagaagatcctattagtaccctagcttcctggatagaaactactttaaagaaccagagatagtggtgcacatctgtagtcccacctattcgagaggctaaggtgggaggatcacttgaggccaggagttcaagaccacgctgagcaaaatagtgggacc

SEQ ID NO: 407711 - DNA, 669 bp, Homo sapiens
cgtctcaaaaaaaaagaatgctcaagatatgtcatgtaatacaacatgcctgttcaaagggggaaaaatcttaggaaataacttacatgtacttcttggtttcatcatacaagacaagcacaaaagcaccacccatgcctctgagaacactggaccatgcacccttgaaaacagctttgcttccttcatcatgagtaatcttcctccagcagtcaaatgtgcctgtgtacatgatgtcagttcctttgcatcctgactgcatcatcatgtagcagcaaatggtgttaaatgaataggaagtcaacccagcaacggcagtgacagtctgtgcatcatccaactgatgacaatgtgagtgttcttgggatccggaagcattccctttgcagtgtcatagttaccgaagtaggcagcaggcagctcggtagataataccctgcacagacacgttaaagccttggtacaggctcttaatcccgtcagatttgtagatcttaactaggcagtcaccgaaacctcgcaattccctttcagctccagctttgcccacatcagctgctacacgagtatgggcaaaatcaagagggtacacaaaacacaaggatgtggccccagtggcaccgcctgatgccagattccctgcaaagtagcgccaaaactgggatctct

SEQ ID NO: 407712 - DNA, 6123 bp, Homo sapiens
agccaatcagaatctcccggcagttggttcccggaggcagaatctgttaaactgacaaagcccacgtctccgggtccctgtctcggggagtcgggactattgggtcaccccgggtagtcgagactctagactgagctgtctcggtcactcaggaggcagttggcagagtattcgtggtcagggaggtgacccgtggtcagcagggtcaggccacccagggacaaagggtgctcctgcaccgggccttggagaaggacagagcggtggggacttggggtcagcgggggagcctccgcggatggggagtcaccacctgccggcaatcagccatgactgcctttgcactgtccatgctctcagcccaccacctcctccccctgccattgcagtggctaacactggagacgaagaccaagacaccacagcctttctccagtacctctcaaatcagcacagacaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctataggatgcacagcttcccatcagcccacctgaactccagccatgccattttaataccaggaataaggtcacctgctttcctgccccttaggaggccggagccgtggaagcaaaatggcacttctgtttacctgttatattatttttttgtcatccttatatgtttgaaaaatgcaattatatgaaaaaagtttagtaattacagacataacagcagaaagtcctcggaaccaagcttattctcatggccgattctgctccacctgggactctgctgtgctgcgggcatcctgtggtcagaatcgcagaggggccatcagggaggaccttcccagaggatggacctcacgtgactgctgcgtgggcaagtggcactggccactctgcctggagagaggagtaaatgcagggctggccaggcgacctgcacactctgctaccggccttgtccatctttagcctctaatttgaaaatgaggatcacacagaccaagagtatctttgagggttagtacagaccacagaaatgccctgggcctttcactctctccttttgcaaattcccatgtgtggaaatgccgtttggataatgagggagcctgaaggaggtggacacatgagcagccccgacaggcctggctccatcctctgaaaatggggccccgtgcccggcgtgtggccttactggttcagtcttctttacagtggtaggttttgagtgcccagatgcccagtgcctcctacccggaacaggacaggaccaggctgtcccctggaagaatcccatgcacacttggctattcagggagtttccacccagccgagctcgcctctgtggctaccctggtcttgctgctcatatctgccaggaaaggcctggacttggagagaaacctgggatttggattcagtccttgccagcctggctggttcatatccttacctctgtctgtggaagcctatgttcctgagcagcgagtcagagggggcatctgaacgcagagcagggagcttcagatgggaagaagtcagaggaaccagaatgtatcagacgatgtggagttgggtgcctgagctcaaagcaagctgggccttgggctggctgtgtgatcttgggcaagttcgaccagcttctttgtgcctcttttctctccttaataagataaatgtcttcactagtacactgagggctgccattaagttctatgtgcagggatccaaggcaggccctaggtctcttggtgagtgctactcctccttacaatttgctgcccggagcaacattgggtgacagaacttcttagcaccttggcagtccttgtcctcctggaccctctgttttgagggtggaatgaggtgaagggcaagtgctttcccagctggtcaggtgctctaccaactgggcatattctaatccccccagagtatacagatcagagtttgatgtggccaatgggtccaatgcccaagtgagaatctcttgatgaagttattggtgtggggttttgctttggtttttaattatagagagcaaaagtattgaaagtattacatttaccctaaaggtgtaagcaagttatggtcaagtgaagatgaagtaccatcctcaaacacgggttccattcttagctcatctcatttaaaggagagaaaagccttgcaggtgaaacatggtgggggtagacaggggttcagccaatttcagtgtttggccccaagaagtgaatttgggtttgaggacctctctctggaaggattttatgaccagatcttcctggagatgatattagaagcttttctcaccaaatatttatttgcctggggtgcaacttctgcttcattctctctttgactccagctgtctttttggactgaagtgcaggttgctcacagcatcctacaaagtaactgtcttcccaaatctcacttacctctgagtttctgctgtattcctgtctttctctctctttttttgaactggaatctattactttggatgatgcatgctggcgttttctaaagttttctgattgattgtgtctttaaaaaataatctgataatattttagcttcttgaattttgtggcatatttttaggcctctcctaaacccatttttgagtgctatgacattgttcatgtatgaagttatgccagtagaaacaaaatgctgtcatataggctcccctaaaacttcaaatctggtccagatcttagactggcagcttctgctgtcattggatctcagtgagacctttgcacccatttcctccctttgtgattcatccacggacatccccatctccttgagaacaatctcaggaatattccttgccttctttcggctctcactccatctcattttctgctgttcactcgggaataaagagatgtcccacactttaaagagtaaaaacaaaaattggagctcagagagggtgaacttgtcaatatcacacagagctgggagtgtggtaagcccttgaaatggggctcaatgacaccgctacctcccagggattcctaatgtctgagggttccagtgagctgagatgaacccagggcctaagaagaactctctgacctcctcacctccaaagccccacccagtgcacatggcctgaggcgtccatggtgatggtaaagaaacctcacctgccatctctcccattactgccatgtcccctctcatcctattctgtgccaaatgtccagatgtgatcaatagaatcaggagaaaattgaggcctgaggggagggggccagactctgggagtggagagtggattgaagtcagactagggctgttcagcaaggagttcagggccttcaagtgttgggagcttggcagcaatgccaaggggaatgggggtggatttgggtccaagtttatgttcgaagaatataagcatgatttggagactcctgatgttcatatgcccccatcaagcagagctaggggtcgccagaggagagaatggtgctagaagttcaggtgagaacagggcagacccctgcataaatgtgggatctctctgtttgaatcacggcccaaacaccgtggcagggacactcccaaggaactcaaacatgtattttatcagggctttaacataaggaatattgattcttaagaaaattggaaacatatgagaatctaatttactctgttatgagatgccatacacctggaagaacaggttaactgtcaaattactaccaaattgttgcaaaaaattgccaatgaagcaatcatacaaagctcaggtaacagagtgggtggccatcactctgggagagggagatagcactggagaaggtccttgtgactcagatcaaagagagcaaatggcaaagaagggggacagttgctgttttctgaagtaaagcctcttaggtgttatttgaccatttgttacctgtgaatgtataattttgatttttaaaataagtagaaaggagcctctttcttaaaaccaaccaatctctgagccccacagatggtattctggtttcttgcaggaggttctgggtcccacccgcctgcccccttctaggacaaccccaccagcaaggaggtcttttagttccttctgtgtgtgttcacctgctcgtcctggcttgggccccagggagcccaggaacctcagggttctctcagctgcacttccatccgtggtgcccaacctcagtgcctaggactctgtgtgcctgacctcctccaggcggggctgctccctccaggtgtccacctggtatgggcatcccgtggcagctctcctctgatgaccgagtgtggtgggggtgctaaggccaacttgctgctggcacgcccagaacttatttgctggctgtttcaaagactccctaaaggcaccatggattttccttagaatacagttctgtgcagtcccgcccatcctcttcccctctgtttcccactagggctgatacttgctttaaggtctgatggctcacccagtccttcataattttcacaatgttatgttccttcctaaaacccttgcagtttaatctgctcttggcgtctgcttctcagaggagctgaggaacagagacttcaacccttcttctctcagttcctgctgcccctgtagtgaggctgacagttgcagaccatagagccagcctggccttgcccagagcatacatgacctcttagtaaggctgggccctgctaagggctatgttttgcacacgttcctgctagtcacatccagcacatctgggctaccacttggatggcaacattacattgaagaccactgtggccatggcaggagtagacaaggtggcagtcttgtcttcagtcgtcatggaaatcccagctatgcagcactagcaggtgttttgtaatggaggatcagatgcttgagcttctgagcaggccccctccctctactgccttctgtcagggtcttggcagcagccggctctggaaggcatcccggctctgggttcaagagcttgctgggcttctacatgaaggtgtgaagtgtgaatgttaccttttctgatttacacttctgttttctgctacaaacttgggatgttttctgagggatgctgaatagatgggggtggatggggggagggaggcaggggctagaaagtgttcttctggggccaccctccagcctggggcatctgatggatgaggaggggagaatctttgagatcctgtttatgagggcactgcaaataccacatttttttcttgtttgcaaattctagtggagaagttttaccaggttgggagagaggcctcagaattaagtccctgtctcctgccacagtttacaccggtgaagcttcctggccgagcataaactcccaggtggagtacaaacagccttcaacaatggcaccatcattggtaccaatggcattgagaggaggtggcactgacaccctaagtgggtggcactgacacctaagacttatggtcttctgctgcctggagagctttgcctccatcactggtgcccaccttgggaattcccaggaattactcttcaaaggtacactcggacgcccactctgcaaggccattttgttcccttacagtgcctctgaaatcattttgagagaggagaatagggaattagggtaaacaacggttaaggcataagcaaaagaacagcaggtgcagccagctctagacagcatataggccacatcctcactcctgttataacaaaacagaagtttccacttcagccttttgtttcatcctgggtaagtccttcatagggtgtaaccaattggaggcctctaaagggcacctaggggtgttgctaaattattaatagcttaaaaccctaaagaacattgtaatcagcgctcttgagccctttacataagttggcttccactctgtggagtgtactttgcttcaataaatctgtgctttcattgcttcaaaaaat

SEQ ID NO: 407713 - DNA, 3451 bp, Homo sapiens
caaacttcaaactttttaatggaacaaggacacacaggcattaatccccagtgtccatcaaagttgcaatgcagccctaacgcctggcatccttgaaagggatgtgcatttagtaatgagatttgctcagcagcgtagtcagctgtgtggtgcattctcagctgtgcctcagcagccctgatgcagacatccagaaggagcacagccactttatccagaggtgaagttttgcagcaagacagcattcatagggggagttctcaacaaatgtcagtccccaaaaagggaactggctttattatggtcattaggatattcactcgtagagaacaggaccttctttcggctctcactccatctcattttctgctgttcactcgggaataaagagatgtcccacactttaaagagtaaaaacaaaaattggagctcagagagggtgaacttgtcaatatcacacagagctgggagtgtggtaagcccttgaaatggggctcaatgacaccgctacctcccagggattcctaatgtctgagggttccagtgagctgagatgaacccagggcctaagaagaactctctgacctcctcacctccaaagccccacccagtgcacatggcctgaggcgtccatggtgatggtaaagaaacctcacctgccatctctcccattactgccatgtcccctctcatcctattctgtgccaaatgtccagatgtgatcaatagaatcaggagaaaattgaggcctgaggggagggggccagactctgggagtggagagtggattgaagtcagactagggctgttcagcaaggagttcagggccttcaagtgttgggagcttggcagcaatgccaaggggaatgggggtggatttgggtccaagtttatgttcgaagaatataagcatgatttggagactcctgatgttcatatgcccccatcaagcagagctaggggtcgccagaggagagaatggtgctagaagttcaggtgagaacagggcagacccctgcataaatgtgggatctctctgtttgaatcacggcccaaacaccgtggcagggacactcccaaggaactcaaacatgtattttatcagggctttaacataaggaatattgattcttaagaaaattggaaacatatgagaatctaatttactctgttatgagatgccatacacctggaagaacaggttaactgtcaaattactaccaaattgttgcaaaaaattgccaatgaagcaatcatacaaagctcaggtaacagagtgggtggccatcactctgggagagggagatagcactggagaaggtccttgtgactcagatcaaagagagcaaatggcaaagaagggggacagttgctgttttctgaagtaaagcctcttaggtgttatttgaccatttgttacctgtgaatgtataattttgatttttaaaataagtagaaaggagcctctttcttaaaaccaaccaatctctgagccccacagatggtattctggtttcttgcaggaggttctgggtcccacccgcctgcccccttctaggacaaccccaccagcaaggaggtcttttagttccttctgtgtgtgttcacctgctcgtcctggcttgggccccagggagcccaggaacctcagggttctctcagctgcacttccatccgtggtgcccaacctcagtgcctaggactctgtgtgcctgacctcctccaggcggggctgctccctccaggtgtccacctggtatgggcatcccgtggcagctctcctctgatgaccgagtgtggtgggggtgctaaggccaacttgctgctggcacgcccagaacttatttgctggctgtttcaaagactccctaaaggcaccatggattttccttagaatacagttctgtgcagtcccgcccatcctcttcccctctgtttcccactagggctgatacttgctttaaggtctgatggctcacccagtccttcataattttcacaatgttatgttccttcctaaaacccttgcagtttaatctgctcttggcgtctgcttctcagaggagctgaggaacagagacttcaacccttcttctctcagttcctgctgcccctgtagtgaggctgacagttgcagaccatagagccagcctggccttgcccagagcatacatgacctcttagtaaggctgggccctgctaagggctatgttttgcacacgttcctgctagtcacatccagcacatctgggctaccacttggatggcaacattacattgaagaccactgtggccatggcaggagtagacaaggtggcagtcttgtcttcagtcgtcatggaaatcccagctatgcagcactagcaggtgttttgtaatggaggatcagatgcttgagcttctgagcaggccccctccctctactgccttctgtcagggtcttggcagcagccggctctggaaggcatcccggctctgggttcaagagcttgctgggcttctacatgaaggtgtgaagtgtgaatgttaccttttctgatttacacttctgttttctgctacaaacttgggatgttttctgagggatgctgaatagatgggggtggatggggggagggaggcaggggctagaaagtgttcttctggggccaccctccagcctggggcatctgatggatgaggaggggagaatctttgagatcctgtttatgagggcactgcaaataccacatttttttcttgtttgcaaattctagtggagaagttttaccaggttgggagagaggcctcagaattaagtccctgtctcctgccacagtttacaccggtgaagcttcctggccgagcataaactcccaggtggagtacaaacagccttcaacaatggcaccatcattggtaccaatggcattgagaggaggtggcactgacaccctaagtgggtggcactgacacctaagacttatggtcttctgctgcctggagagctttgcctccatcactggtgcccaccttgggaattcccaggaattactcttcaaaggtacactcggacgcccactctgcaaggccattttgttcccttacagtgcctctgaaatcattttgagagaggagaatagggaattagggtaaacaacggttaaggcataagcaaaagaacagcaggtgcagccagctctagacagcatataggccacatcctcactcctgttataacaaaacagaagtttccacttcagccttttgtttcatcctgggtaagtccttcatagggtgtaaccaattggaggcctctaaagggcacctaggggtgttgctaaattattaatagcttaaaaccctaaagaacattgtaatcagcgctcttgagccctttacataagttggcttccactctgtggagtgtactttgcttcaataaatctgtgctttcattgcttcaaaaaat

SEQ ID NO: 407714 - DNA, 317 bp, Homo sapiens
aagtgctgggattacaggcatgagccaccgtgcccggcccataaatatttcttagtttgtaaaaatgtaacttaaaaacctaaaatatcaaaaaaaatacgaaattgaactatcataggaattcaggctgtacaagtttccatgatgtcgactcactaggaagcttctaggacagcagggagcagaggggaattctcaggacagcagcaccatcctgcacctcccagaaaaggagaggcctggtcctctggccacaggggccagcaacagggggaaagaaactaaaacccaggacttgaaccaccatgtcttctttg

SEQ ID NO: 407715 - DNA, 428 bp, Homo sapiens
aactcaccaagttggacagttcagtggtttttagtatatgcacagagttgtataatcatcatcacaatgaattttagaatattcttaccacctcacagccctaggcagccaccatgggtttgcctgtcccagacatttcatgtaactggaatcatttgtggtcttttgtcactggcatctttcatgtaccatatttttgaggttcttccacgtggcatgtgttagtacttcactcctttctataactgattttttttttttttttttttttggagacagagtttcactcttgtcacccaggctggagagccaatggtgcgatcttggcttactgcaacctctgcctcctgggttcaagcgattctcctgcttcagcctcccaagtagctgggattacaggtgcatgccaccatggccggctaatgttt

SEQ ID NO: 407716 - DNA, 182 bp, Homo sapiens
atgccagctcattcattcaacaaatatttattttgtgcatattatgatccaggcagtgctctaggcaccaaaggtacagaaatgaacaaaacaaagtcccttctgtcatacagcttacaatctagtgggggagattatttttataaactaaaagaacatccttattgatgtgctgattcctg

SEQ ID NO: 407717 - DNA, 409 bp, Homo sapiens
actgcttgacccccggagtttaaatgcagcctgctagcaagactccctatctttaaaaaaacaaaaaaagaaaaaaatctctttctctcacctcctctccccccaacccccatacaagtgaacaaattaaaagatgtgcagaccaggattagagttctgcaaaaattcaatagatgtttgtctttaaatttttactacaaatactttcaaaagcaccatgacccatatggatgaatgagcaaagaatttgagaagttgggctcatttactaaagaggaaatgcaggtacaagcataagggacatgtttttccctgacaggtaattgaagaagtgaaattttaatatgtagtgatttttttttttttactttttgagttagcagaagtatttttctaatgatgtttttgc

SEQ ID NO: 407718 - DNA, 168 bp, Homo sapiens
agcactcttgcagcgattacagctgagttttgatgcaactctacaagccagaggggattgcccccattttatacatggggaaactaagcacacacaacagcagtacttggtagtagtattgagtagtagtactgagcagtagtactcagctggtagaaggcagaccgg

SEQ ID NO: 407719 - DNA, 599 bp, Homo sapiens
tgaggaatctctaaactaccttccataatggctccattattttacattcccactagcaatgttaaaggatttaagtttttccatatccttgccaacacttgttattttctgtattattattatattattattgccatcctagtagatgtgaaatggtatctcattgtgattttgatttgcatttccctaataactaatggtgtagagcatattttcaactgcatgttggctatttgtatatcttcttttgagaaatgtctgttcaagtcctttgatcagtactttttttaactgggttctttttgttgtggggttgtagaagttctttatatattctgtatgttaaatctttatcagatatatgatttacaaatattttcttccattctgtaaattgtctttttactttctttacaatgttctttgatgcccaaaagtttttaattttgatgaaatccaatttatctattttgttgttgttgcttgatgttagctgtgggtttttcattataccctttatcaagttgaggaagttcccttctattcccagttttctgctggtttttattagggaataaaatgcctattctgctcaattg

SEQ ID NO: 407720 - DNA, 482 bp, Homo sapiens
tcacatgttctgacttatttattggagctaaagatgaaaacaactgaacttctagagatagagtagaagaatgtttaccagaggctgggaaaggtagtgggggcatgatgagggggaattggggaatgttaatgggcacaaaaaggtagaatgactaagacctagtatttgatagcacaacaaggttactacagtcaataataattgtacatttttaaggtataattgaattgtttgtaacacaaaggataaatgcttgaggttatggatatcccatttaccctgatgtgattattagacattgcaaacctgtatcaatatatcatgtaccccatagatgtatacacctagtatgtacccaaaaaaattaaaaataaagtaaaaatttcaatgattaggaagaccattattaatatgttttctttaaatgtttctgtaaatttgatacaatttcaataaagcttccaatatttattcttagt

SEQ ID NO: 407721 - DNA, 381 bp, Homo sapiens
gcaacgtcaaataaccacccctgaattcccagagaaaagtccaatagctggtgggaatcaaaacaaggaaagaaaaagacaggacagttcggctgtaagacctgagtaagcgctggtggagtgtctgaggcacagttggccgcagagatcttcctagctggaccctgccccctctgggagaagtgattgctcagacctcaaggctccattcagatacctgcgcgaaggcctatgcctgaagactgggaggctacagcccacatgacacttccctgggccccgattgagatatctggtgagttttagcatccgatgcacgcacactcttatctggcccagccactgggagacttatttcaaatgaatcaccagagccatctt

SEQ ID NO: 407722 - DNA, 781 bp, Homo sapiens
agggtgtttctccatgttggtcagtctggtcttgaaatcctaacctcagctgatccacccacctcggcctcccaaagtggtgggattacaggcgtgagccactgcaactggctcttttaaatgtaattttatttatttatttatttttgagcctgttttgcagcctttacaaaaatcagggttttcccacaagatcatgaagattttcatataagggacctctgaccatttgtgttggcgttggcagtaaaggtcaagcaggaataaggtaataacattcaagctccccacctttggccaggttcctgcctttctagttcatattttggccaaacctagctactcgccaggctgaggcaagagaatcacttgaacccggagggcaggcggaggttgcagcgagccaagatcgcaccattgcactgcagcctgggcaaaaagaaagaaacttagtctaaaaaaaagaaaaaatcaagacccttctcctctctccgtcatcgtagtgtgtgcttgacttggcttcttgccatgtcttctcacaagactttcaggattaagagagtcctggccaagaaacaaaagcagaattgttccattccccagtggattcgcatgaaaactgataataaggtcacaatcacgcaaccatatcaagctgaaaatgtcacccctatctggagagttggacatgttttattgggaatatattttttatctctgactctgttacgaacacattggttggctaggttcggtaataaatatgtgaaacattttattt

SEQ ID NO: 407723 - DNA, 962 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagcgctgggcaagaacccgtcctaggaccaggcctctgtaagggctgtgggtgcagcaaggagtgggaaggcacctgccatgtcccggccccaagacagctctgcccaccgagccctctcagaccagcttgccctgggacttctagcccatcttgcctgccctgctctgcctgccctgtctgcccggggcctcttgtatctgcttttgaagtctgtcctctaccacctcaagggtggtctcagtttaaaaagccttatcactgaaagcattcatattaaattatatgatatctgggatttgcttc

SEQ ID NO: 407724 - DNA, 369 bp, Homo sapiens
ctctctctctctctctctctctctctctctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcagaaaaaaaaa

SEQ ID NO: 407725 - DNA, 1098 bp, Homo sapiens
tagcaggctgttactggtccggagatttttggatggataaagataaagtttctctaaccaagaccccaaaactggagcgtggcgatggcgggaaggaggtgagggagcgagccagcaagcggaagctgcccttcaccgcgggcgccaatggggagcagaaggactcggacacaggaccgccggggtcctgcttgtcctggggcagccacgagggagccctcgtcaggagcgccatgggccgaagctgcctgccctctgcacgtggatgtttctttggaacaaggggaaaaattatgattttcttattttgctttgacctgtgaatgacaccctggtctctggtgcctggggtgtgctctctgcagtgctgccaggcacatgctggttccttcagcgttaggtgcttggcaccttcagtcttttcctgacgtcatgtttgttcctggtgcctcagataggagacggctgttctgacggctcctgcttccccattcctggagggaagacagacttagccactggtatctgtgggacttcttggaactctgaatgccagaccttgcccagtgctagaggcgacaagtgtgtgaagttgaagaggcttctcccacctgctcagctgcagtggacccgagcgggcagagagagcagagtgcagcaggggccaggctgtgctcgcaggcggggcaggtgcctggagagcatggcgcccctgggagcctctggccaggaagggcatgtgctctgcagtgtgccgtggaccagtggcctcagctcagtgtgttgacgagggtcccaaggcactcacgtgtgtggggatgttagcaacacacggcgggaagccctgatgcagtttctcaccaagcgtgtagcagaccccacgcaccccacacaggtcaggcaccccacacagggcacagaccccacacaccccacacagggcaggcacctcacacagggcacagaccccacgcacccgacacagggcaggcacctcacacagggcacagaccccacgcatcccacacagggcaggcaccccacacagggcacagacccacgcaccccacacagggcagggatcccacgcagggcaca

SEQ ID NO: 407726 - DNA, 443 bp, Homo sapiens
gccctgatcagagcagctgcctgccttgactagttactgagtctgttgagtgcggtgtgagagtggatgagttttgagctgcctctgaattcagtgaattgtgtgtcttctcttttgaagcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggtaatgctgccccctcccagccctgcatgctcaccgcacccagatggggatgaggtgggaatggggtgctgcccgcctgtggcctgttctccgccctccggccctttcctcgtgcctctgtctgcagccaggagtggagagggtggtgaggagtgatctttcccaaagtggccttgc

SEQ ID NO: 407727 - DNA, 4798 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407728 - DNA, 5001 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccga

SEQ ID NO: 407729 - DNA, 4895 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagatgcctccagcccagtccctgttgtggtgctgcaaggctggtacgctcctcgaagcaccatggcatgagatggaggttcctagaagcaagaagaaagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407730 - DNA, 3049 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaagggttggcatccccccgttcttcacacatccggcctgtcctggcatctgggtggttctgtagctttgtttccccgtagctagccggttccatgatgtggggcacaggaaagcgagttttcgccttgcccaccctcaaggccgagctgtgccctctgtctgcccccagctttccccttctgggtcagcctggacggcctctcacaggtttcccagcaagtgccatctatgaaaggctcgtatccgctagccgtgtaggtctggttggatttgagcaggtgaaggattacaccaagtggaaggaggcctgcaggagttgctgccggtccccgtcaccactgtgggactgttagacctgcaaggcagacccaccctcgtctggaatgaggtaacaccaagaggtgtggccagtgcacagaaccatagactcaagctttagaaagtggccattgtggccggcccaggagcagtgggcactgagaggtctcagcctctgtgggggtcgagagaggtcgtggtgtgcctgacagccccgtcctgccggaaagcaggggtgctgcctggagatgcggcgggtctcactgatgtcttcgtcagagctccgtggagagcccctggttgcaggcaggacagcaaggctgaggggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttttatgggctcttccagagacgtgaactggaaaaggctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcaggcccagggcagccccatgggcccttaaagcttgagagcctttcctgctgagtctgagagatgccagaagcaggagaggttagaacccgaggagggccgcacctgcgctgctggccttagaggagggccgaggagtgtggtggcccctaagcagctgggactggggacctccgtcccagccctgcaagaaactgaattctgccagcagcccccatgatggaggaaaggaaggatcctgccctgccagcaccttgacctctgacctccacaattgtaagcctgaggttttgtgtagtcaccatagaaaactcacacacataagaactctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcagaaaaaaaaa

SEQ ID NO: 407731 - DNA, 4280 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407732 - DNA, 2974 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgcccgtgcagcctgccaggactcttccagacacgggatttgtcggtgaacaacgcagagctgatgcagacataatatatacagccctgctctgggacacacctccattggatttaaaagacagtcctcgtcagcactgactttcagctatggaatcggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaagggttggcatccccccgttcttcacacatccggcctgtcctggcatctgggtggttctgtagctttgtttccccgtagctagccggttccatgatgtggggcacaggaaagcgagttttcgccttgcccaccctcaaggccgagctgtgccctctgtctgcccccagctttccccttctgggtcagcctggacggcctctcacaggtttcccagcaagtgccatctatgaaaggctcgtatccgctagccgtgtaggtctggttggatttgagcaggtgaaggattacaccaagtggaaggaggcctgcaggagttgctgccggtccccgtcaccactgtgggactgttagacctgcaaggcagacccaccctcgtctggaatgaggtaacaccaagaggtgtggccagtgcacagaaccatagactcaagctttagaaagtggccattgtggccggcccaggagcagtgggcactgagaggtctcagcctctgtgggggtcgagagaggtcgtggtgtgcctgacagccccgtcctgccggaaagcaggggtgctgcctggagatgcggcgggtctcactgatgtcttcgtcagagctccgtggagagcccctggttgcaggcaggacagcaaggctgaggggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttttatgggctcttccagagacgtgaactggaaaaggctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcaggcccagggcagccccatgggcccttaaagcttgagagcctttcctgctgagtctgagagatgccagaagcaggagaggttagaacccgaggagggccgcacctgcgctgctggccttagaggagggccgaggagtgtggtggcccctaagcagctgggactggggacctccgtcccagccctgcaagaaactgaattctgccagcagcccccatgatggaggaaaggaaggatcctgccctgccagcaccttgacctctgacctccacaattgtaagcctgaggttttgtgtagtcaccatagaaaactcacacacataagaactctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcagaaaaaaaaa

SEQ ID NO: 407733 - DNA, 3059 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaagggttggcatccccccgttcttcacacatccggcctgtcctggcatctgggtggttctgtagctttgtttccccgtagctagccggttccatgatgtggggcacaggaaagcgagttttcgccttgcccaccctcaaggccgagctgtgccctctgtctgcccccagctttccccttctgggtcagcctggacggcctctcacaggtttcccagcaagtgccatctatgaaaggctcgtatccgctagccgtgtaggtctggttggatttgagcaggtgaaggattacaccaagtggaaggaggcctgcaggagttgctgccggtccccgtcaccactgtgggactgttagacctgcaaggcagacccaccctcgtctggaatgaggtaacaccaagaggtgtggccagtgcacagaaccatagactcaagctttagaaagtggccattgtggccggcccaggagcagtgggcactgagaggtctcagcctctgtgggggtcgagagaggtcgtggtgtgcctgacagccccgtcctgccggaaagcaggggtgctgcctggagatgcggcgggtctcactgatgtcttcgtcagagctccgtggagagcccctggttgcaggcaggacagcaaggctgaggggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttttatgggctcttccagagacgtgaactggaaaaggctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcaggcccagggcagccccatgggcccttaaagcttgagagcctttcctgctgagtctgagagatgccagaagcaggagaggttagaacccgaggagggccgcacctgcgctgctggccttagaggagggccgaggagtgtggtggcccctaagcagctgggactggggacctccgtcccagccctgcaagaaactgaattctgccagcagcccccatgatggaggaaaggaaggatcctgccctgccagcaccttgacctctgacctccacaattgtaagcctgaggttttgtgtagtcaccatagaaaactcacacacataagaactctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaatgcgatagcggagatgagggatagctactgattgataacatcgaaagagtcttcaaataaatggcgagctaccaga

SEQ ID NO: 407734 - DNA, 2554 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaagatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggcctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaatgctctttgt

SEQ ID NO: 407735 - DNA, 2499 bp, Homo sapiens
atcggttgatctagaggatcccagttcgacggagactctcctcttttgtcctggctacctttcggaaaaggacaagaagaggagagagtccgcagaggccgggcgggacagaaaggacgccctgtgagagctgcaagggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407736 - DNA, 2271 bp, Homo sapiens
aaagatacaaagagaaatccagtgacaaggacaaaagtgagaaatcaatcctggaaaaatgtcagaaggacaaagaatttgataaatgttggcacgaggaaaaaagataccaaggaaaaacataaagacacacatggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407737 - DNA, 2164 bp, Homo sapiens
gagctcggtaccccacaccacctgagtcagagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407738 - DNA, 2023 bp, Homo sapiens
cgaacactgtggcacaagctcaggccgcagacggtgccggccccgaggacgacactgaggcctcccgtgccgccgccccagccgaaggccctcctggcggcatccagccggaagccgcagaaccaaaacccacggccgaagccccgaaggccccccgagtggaggagatccctcagcgcatgaccaggaaccgggcgcagatgctcgcgaaccagagcaagcagggcccgcccccctccgagaaggagtgcgcccccacccctgccccggtcaccagggccaaggcccgcggctccgaggacgacgacgcccaggcccagcatccgcgcaaacgccgctttcagcgctccacccagcagctgcagcagcagctgaacacgtccacgcagcagacgcgggaggtgatccagcagacgctggccgccatcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtgatcgcaccccctccctccctggcggagcccctgaaggagctgttcaggcagcaggaggccgtccggggaaagctgcgtctacagcacagcatcgagcgggagaagctgatcgtatcctgtgagcaggagattctgcgggttcactgccgggcggccaggaccatcgccaaccaggcagtgccattcagcgcctgcacgatgctgctggactccgaggtctacaacatgcccctggagagccagggtgacgagaacaagtcagtgcgcgaccgtttcaacgcccgccagttcatctcctggctccaggacgtggatgacaagtatgaccgcatgaagacttgcctcctcatgcggcagcagcacgaggccgcggcctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaatgctctttgt

SEQ ID NO: 407739 - DNA, 1515 bp, Homo sapiens
aaagatacaaagagaaatccagtgacaaggacaaaagtgagaaatcaatcctggaaaaatgtcagaaggacaaagaatttgataaatgttggcacgaggaaaaaagataccaaggaaaaacataaagacacacatggcgataaggaaaggaaggagaagacaaaaccagaaagatacaaagagaaatccagtgacaaggacaaaagtgagaaatcaatcctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccga

SEQ ID NO: 407740 - DNA, 375 bp, Homo sapiens
tcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtggtgagtgcggggcccgggagagccactgccttctctctctgggatgcgtctggggcccctagtcacggctttctccagcccgtcttgtcccactcatggcccttgacctctctcgacctttctgccacctgaggagacacagccccacttctgctgt

SEQ ID NO: 407741 - DNA, 832 bp, Homo sapiens
  misc_feature (813)..(813): n is a, c, g, or t
atcggttgatctagaggatcccagttcgacggagactctcctcttttgtcctggctacctttcggaaaaggacaagaagaggagagagtccgcagaggccgggcgggacagaaaggacgccctgtgagagctgcaagggagcgcagggacggcagggccaagcccgaggaggcgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagtctgaagccgtctggaggtnagacctcgatcgtatagta

SEQ ID NO: 407742 - DNA, 448 bp, Homo sapiens
aagatggaaatggagcccacgactctgcagtgcatcctgatgccgcgctgacctgacggcttgtgcgtgtccctttggctgcaccagtgagcacagtggcaggcgtgtcagagaaagggccccttctgcagacggtctctcaccattgccgaccacggaatcccagaaccgctgagctgcctcgggaagaaccagcaggataaagataaagtttctctaaccaagaccccaaaactggagcgtggcgatggcgggaaggaggtgagggagcgagccatcagtgccctgtgtcagaaatatcctcgcaaacacgccgtccttatgaacttcctgttcaccatgctgcgggaagagggtggctttgagtataaacgcgctatcgtggactgcatcatcagcatcattgaagagaactcagagagcagaaggtcactcacagatcctgtat

SEQ ID NO: 407743 - DNA, 4652 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407744 - DNA, 4917 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagtgctctgtgttgatgccttcagatgcctccagcccagtccctgttgtggtgctgcaaggctggtacgctcctcgaagcaccatggcatgagatggaggttcctagaagcaagaagaaagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407745 - DNA, 4966 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgcccgtgcagcctgccaggactcttccagacacgggatttgtcggtgaacaacgcagagctgatgcagacataatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagatgcctccagcccagtccctgttgtggtgctgcaaggctggtacgctcctcgaagcaccatggcatgagatggaggttcctagaagcaagaagaaagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407746 - DNA, 2797 bp, Homo sapiens
gccctgatcagagcagctgcctgccttgactagttactgagtctgttgagtgcggtgtgagagtggatgagttttgagctgcctctgaattcagtgaattgtgtgtcttctcttttgaagcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagaagcagggccctgagcggaagaggattaagaaggagcctgtcacccggaaggccgggctgctgtttggcatggggctgtctggaatccgagccggctaccccctctccgagcgccagcaggtggcccttctcatgcagatgacggccgaggagtctgccaacagcccagtggacacaacaccaaagcacccctcccagtctacagtgtgtcagaagggaacgcccaactctgcctcaaaaaccaaagataaagtgaacaagagaaacgagcgtggagagacccgcctgcaccgagccgccatccgcggggacgcccggcgcatcaaagagctcatcagcgagggggcagacgtcaacgtcaaggacttcgcaggctggacggcgctgcacgaggcctgtaaccggggctactacgacgtcgcgaagcagctgctggctgcaggtgcggaggtgaacaccaagggcctagatgacgacacgcctttgcacgacgctgccaacaacgggcactacaagggttggcatccccccgttcttcacacatccggcctgtcctggcatctgggtggttctgtagctttgtttccccgtagctagccggttccatgatgtggggcacaggaaagcgagttttcgccttgcccaccctcaaggccgagctgtgccctctgtctgcccccagctttccccttctgggtcagcctggacggcctctcacaggtttcccagcaagtgccatctatgaaaggctcgtatccgctagccgtgtaggtctggttggatttgagcaggtgaaggattacaccaagtggaaggaggcctgcaggagttgctgccggtccccgtcaccactgtgggactgttagacctgcaaggcagacccaccctcgtctggaatgaggtaacaccaagaggtgtggccagtgcacagaaccatagactcaagctttagaaagtggccattgtggccggcccaggagcagtgggcactgagaggtctcagcctctgtgggggtcgagagaggtcgtggtgtgcctgacagccccgtcctgccggaaagcaggggtgctgcctggagatgcggcgggtctcactgatgtcttcgtcagagctccgtggagagcccctggttgcaggcaggacagcaaggctgaggggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttttatgggctcttccagagacgtgaactggaaaaggctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcaggcccagggcagccccatgggcccttaaagcttgagagcctttcctgctgagtctgagagatgccagaagcaggagaggttagaacccgaggagggccgcacctgcgctgctggccttagaggagggccgaggagtgtggtggcccctaagcagctgggactggggacctccgtcccagccctgcaagaaactgaattctgccagcagcccccatgatggaggaaaggaaggatcctgccctgccagcaccttgacctctgacctccacaattgtaagcctgaggttttgtgtagtcaccatagaaaactcacacacataagaactctgtactgattcaacaatagaacatgtcacacacgaactggaaactgattctgtgggcgacaagagtctatagtaaacgttatgacagattctttgaatgcgctaatctcagactggactaaagttgggattaaatttaatttgtacttgagttcagtgcattgctgttctgggcataggaaatccaggttgctggtgatgaacagctgaaaagagctgtgtcaccatggttgtctctgtcagtcatgtgaccacccttacccttgtaaaatcaagcaagggagagattattttctaatgtaaatgaaaataaaaaataaagcagcttgcagaaaaaaaaa

SEQ ID NO: 407747 - DNA, 3684 bp, Homo sapiens
cttatagaggatccccaacccgggaccgcttttaacgacgctgcacaacgggcactacaaggtggtgaagctgctgctgcggtacggagggaacccgcagcagagcaacaggaaaggcgagacgccgctgaaagtggccaactcccccacgatggtgaacctcctgttaggcaaaggcacttacacttccagcgaggagagctcgacggagagctcagaagaggaagacgcaccatccttcgcaccttccagttcagtcgacggcaacaacacggactccgagttcgaaaaaggcctcaagcacaaggccaagaacccagagccacagaaggccacggcccccgtcaaggacgagtatgagtttgatgaggacgacgagcaggacagggttcctccggtggacgacaagcacctattgaaaaaggactacagaaaagaaacgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407748 - DNA, 3270 bp, Homo sapiens
agtacggctaggttacgaggccggggtgaaatccaatagttttatctctatacccaaaatggaggttaaaagttacactaaaaataacacgattgcaccaaagaaagcgtcccatcgtatcctgtcagacacgtcggacgaggaggacgcgagtgtcaccgtggggacaggagagaagctgagactctcggcacatacgatattgcctggtagtaagacacgagagccttctaatgccaagcagcagaaggaaaaaaataaagtgaaaaagaagcgaaagaaagaaacaaaaggcagagaggttcgcttcggaaagcggagcgacaagttctgctcctcggagtcggagagcgagtcctcagagagtggggaggatgacagggactctctggggagctctggctgcctcaaggggtccccgctggtgctgaaggacccctccctgttcagctccctctctgcctcctccacctcgtctcacgggagctctgccgcccagaagcagaaccccagccacacagaccagcacaccaagcactggcggacagacaattggaaaaccatttcttccccggcttggtcagaggtcagttctttatcagactccacaaggacgagactgacaagcgagtctgactactcctctgagggctccagtgtggaatcgctgaagccagtgaggaagaggcaggagcacaggaagcgagcctccctgtcggagaagaagagccccttcctgtccagcgcggagggcgctgtccccaaactggacaaggaggggaaagttgtcaaaaaacataaaacaaaacacaaacacaaaaacaaggagaagggacagtgttccatcagccaagagctgaagttgaaaagttttacttacgaatatgaggactccaagcagaagtcagataaggctatactgttagagaatgatctttccactgaaaacaagctaaaagtgttaaagcacgatcgcgaccactttaaaaaagaagagaaacttagcaaaatgaaattagaagaaaaagaatggctctttaaagatgaaaaatcactgaagagaatcaaagacacaaacaaagacatcagcaggtctttccgagaagagaaagaccgttcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacagccgggcccgggagaagcgagactacagagagcccttcttccgaaagaaggacagggactatttggataaaaactctgagaagaggaaagagcagactgaaaagcataaaagtgtccctggctacctttcggaaaaggacaagaagaggagagagtccgcagaggccgggcgggacagaaaggacgccctggagagctgcaaggagcgcagggacggcagggccaagcccgaggaggtgcaccgggaggagctgaaggagtgtggctgcgagagtggcttcaaggacaagtccgacggcgactttgggaagggcctggagccgtgggaacggcaccacccagcacgagagaaggagaagaaggatggccccgataaggaaaggaaggagaagacaaaaccagaaagatacaaagagaaatccagtgacaaggacaaaagtgagaaatcaatcctggaaaaatgtcagaaggacaaagaatttgataaatgttttaaagagaaaaaagataccaaggaaaaacataaagacacacatggcaaagacaaagaaaggaaagcgtctctcgaccaagggaaagagaagaaggagaaggctttccctgggatcatctcagaagacttctctgaaaaaaaagatgacaagaaaggcaaagagaaaagctggtacatcgcagacatcttcacagatgagagtgaggacgacagagacagctgcatggggagcgggttcaagatgggagaggccagcgacttgccgaggacggacggcctccaggagaaggaggaaggacgggaggcctatgcctccgacagacacaggaagtcttctgacaagcagcaccctgagaggcagaaggacaaggagcccagagacaggagaaaggaccgaggggctgccgacgcggggagagacaaaaaagagaaagtctttgaaaagcacaaggagaagaaggataaagagtccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcct

SEQ ID NO: 407749 - DNA, 1581 bp, Homo sapiens
gagggcctttgccggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaagcttgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacaggaccgccggggtcctgcttgtcctggggcagccacgagggagccctcgtcaggagcgccatgggccgaagctgcctgccctctgcacgtggatgtttctttggaacaaggggaaaaattatgattttcttattttgctttgacctgtgaatgacaccctggtctctggtgcctggggtgtgctctctgcagtgctgccaggcacatgctggttccttcagcgttaggtgcttggcaccttcagtcttttcctgacgtcatgtttgttcctggtgcctcagataggagacggctgttctgacggctcctgcttccccattcctggagggaagacagacttagccactggtatctgtgggacttcttggaactctgaatgccagaccttgcccagtgctagaggcgacaagtgtgtgaagttgaagaggcttctcccacctgctcagctgcagtggacccgagcgggcagagagagcagagtgcagcaggggccaggctgtgctcgcaggcggggcaggtgcctggagagcatggcgcccctgggagcctctggccaggaagggcatgtgctctgcagtgtgccgtggaccagtggcctcagctcagtgtgttgacgagggtcccaaggcactcacgtgtgtggggatgttagcaacacacggcgggaagccctgatgcagtttctcaccaagcgtgtagcagaccccacgcaccccacacaggtcaggcaccccacacagggcacagaccccacacaccccacacagggcaggcacctcacacagggcacagaccccacgcacccgacacagggcaggcacctcacacagggcacagaccccacgcatcccacacagggcaggcaccccacacagggcacagacccacgcaccccacacagggcagggatcccacgcagggcaca

SEQ ID NO: 407750 - DNA, 1086 bp, Homo sapiens
cgctacaaggcccgtgacgtggatacaagtataccgcattaagacttgcctcctcatgcggcagcagcacgaggccgcggcctgaacgccgtgcagaggatggagtggcagctgaaggtgcaggaactggaccccgccgggcacaagtccctgtgcgtgaacgaggtgccctccttctacgtgcccatggtcgacgtcaacgacgactttgtattgttgccggcatgacaccgcgggacggccgcaggacgcaggcgagggccgcacggctgcccaggactgctgctgagccccaggggcggaggagggagcgccctgtccacccgggcggggagagaccccgagagagactgcacttggccacagcgcctccatcccttccagactggtccagacgtcggggaggtgaaacacgtctcttctctaccagctgccgcggcgggggcaaagcccccagagcctcactggccccggcgggatgaggagaccatgccgggcgcgcacacacggcagcttctgtttgaaaacggcgaccttcgggcccttttctccagcaactgcagaggcatttcaggagttggagaacggagtacatttttaaaattttttgttccattctgatcaactaaagaaaattaaggtgtccacctctcacaaacagtgacctgcaggtcggaggggcaggagccccatcccagccgtggttctgttgccgccgagctgcgacggcctcagactgggcttcagacctggtgcggagccaggcggagggacacagagccaggactcccagccgtattgaaatggagtcaaatccgcgtggtttgtatcttctttcctttaatcttgggcattttgtttctctttctgagaacgtaacttgaaacactacagagccaataatcatataaaaagtgtatccgtaaacgctgtacagttttatataccttcacaatgtacttttgctgccttctagataatttattttgcaacacattactgcacagttgtaaataacttatgtactgtaacatcactttcagttatgtgtaaagaaataaataaattaattaaaatgctctttgt

SEQ ID NO: 407751 - DNA, 954 bp, Homo sapiens
gcggccgctgcccgccttaatccacagaaaagtacaaggacaggaaggacagagcctcagtggactccacgcaagataagaaaaataaacagaagctccccgagaaggctgaaaagaagcacgctgccgaagacaaggctaaaagcaaacacaaagagaagtcggacaaagaacattccaaggagaggaagtcctcgagaagtgccgacgcggaaaaaagcctgcttgaaaagttggaagaagaggctctccatgagtacagagaagactccaacgataaaatcagcgaggtctcctctgacagcttcacggaccgagggcaggagccggggctgactgccttcctggaggtctctttcacggagccacctggagacgacaagccgagggagagcgcctgcctccctgagaagctgaaagagaaggagaggcacagacactcctcatcttcatccaagaagagccacgaccgagagcgagccaagaaagagaaggccgagaagaaagagaagggcgaagattacaaggagggcggtagcaggaaggactccggccagtacgaaaaggacttcctggaggcggatgcttacggagtttcttacaacatgaaagctgacatagaagatgagctagataaaaccattgaattgttttctaccgaaaagaaagataaaaatgattccgagagagaaccttccaagaaaatagaaaaggaactaaagccttatggatctagtgccatcaacatcctaaaagagaagaagaagagagagaaacacagggagaaatggagagacgagaaggagaggcaccgggacaggcatgcggatgggctgctgcggcatcacagggacgagctcctgcggcatcacagggacgagcagaagcccgccaccagggacaaggacagcccgccccgcgtgctcaaagacaagtccagggacgagggcccga

SEQ ID NO: 407752 - DNA, 396 bp, Homo sapiens
aaaacaaaaaaaaacaaaaacaaaaaacaagacaaacaagaccaaaaacccccgagacaagacgacccacagcgtacgaaggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407753 - DNA, 1818 bp, Homo sapiens
ccgccgtaccagttgcccagttcgtccctttccacctttacagtgaatgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407754 - DNA, 1771 bp, Homo sapiens
tggcgaattcggcacgagggagagagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407755 - DNA, 2069 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtgagtggacctggagcccggctggggcctccgctttcccgactcctctccttccttcctgggtcttcactgtctcctctccccaccgtctttctctccatcaagcacccggattccgtgtcctcctctgatcctctctggctttcaggtggtgggtgtttttagacctgagactgtggcctcccagcccagcctgggagaaggggaggagagtgagtccaactcggtggagtccttgggcttctgcagtgtgtgagtgaggatggggaaaggggtttgtgggaggggcctgggctgggggcccgggaggacggcagggcgtgtgagtccaggccctcatgagtcttcatggtacgctcctctggccagggatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407756 - DNA, 1730 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtcggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407757 - DNA, 1791 bp, Homo sapiens
  misc_feature (1331)..(1331): n is a, c, g, or t
  misc_feature (1333)..(1333): n is a, c, g, or t
  misc_feature (1386)..(1386): n is a, c, g, or t
  misc_feature (1391)..(1391): n is a, c, g, or t
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagattcctccctggtgtnanccacgtttttattttttttttttttatattttttttttttttaaattcttttnttttntttgttttcattggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407758 - DNA, 2098 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatggtgagagcacctcccttgagtgacctttcctgggtgcagaggccgaatcccgggatatacacctcccagagcagccttctgggtcacagccggcaaaatctgaggcctgctgtttgcagtgctgacctcctgggccccaaagttcacagcgcctccttcctgctctgaactcacctgtgattcctggggcagtgtctgggcccttccactcttctttcctctccctctccccattcccttgcttagtgtatgtgagcgtgccctctgccctctcttcatctgtgcctctcttcagggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407759 - DNA, 1773 bp, Homo sapiens
ctggccagccgtggcctcccgtcctgtgtcccgcgcgcccccgcggaccccggtgtgtctgactccaccttcccttctcgccacatgacccgccccagcctcaggcctcctcatgcttctctccgtacctcttaccgcctcccgagccccatcttctaaccctctccccaaagcaatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407760 - DNA, 1441 bp, Homo sapiens
  misc_feature (27)..(27): n is a, c, g, or t
cggacgcgtgggtcgacccacgcgtcngaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407761 - DNA, 1365 bp, Homo sapiens
aacgtaggctagtacgaggctggggtgtgaatcggccgaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407762 - DNA, 1003 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcactgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407763 - DNA, 1002 bp, Homo sapiens
gagatttaggctaggtacgaggctgggtgttagactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcactgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407764 - DNA, 444 bp, Homo sapiens
ccgccgtaccagttgcccagttcgtccctttccacctttacagtgaatgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407765 - DNA, 520 bp, Homo sapiens
ccgccgtaccagttgcccagttcgtccctttccacctttacagtgaatgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcaggtaggtctttgaggcgatccacctcaaatcagtttaggtgggcgtgtaagcattaaacatcagccatggacagaacgttatgggggacacagagatgggcaagatgctggccttgcgctggaggagcccacaggtgggaaagtgtgg

SEQ ID NO: 407766 - DNA, 1803 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407767 - DNA, 1921 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgtgagtgaggatggggaaaggggtttgtgggaggggcctgggctgggggcccgggaggacggcagggcgtgtgagtccaggccctcatgagtcttcatggtacgctcctctggccagggatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407768 - DNA, 1744 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407769 - DNA, 1764 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407770 - DNA, 1662 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtcagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407771 - DNA, 1650 bp, Homo sapiens
ctggccagccgtggcctcccgtcctgtgtcccgcgcgcccccgcggaccccgatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407772 - DNA, 1712 bp, Homo sapiens
ccgccgtaccagttgcccagttcgtccctttccacctttacagtgaatgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407773 - DNA, 1188 bp, Homo sapiens
  misc_feature (27)..(27): n is a, c, g, or t
cggacgcgtgggtcgacccacgcgtcngctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407774 - DNA, 1023 bp, Homo sapiens
aggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcacttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407775 - DNA, 537 bp, Homo sapiens
ccgccgtaccagttgcccagttcgtccctttccacctttacagtgaatgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagaaaaaaaaaaa

SEQ ID NO: 407776 - DNA, 853 bp, Homo sapiens
ccgccgtaccagttgcccagttcgtccctttccacctttacagtgaatgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagaggaagaaatagaaatgatgaagttaatgggactttggcctccctttgactccacaaaagggtaagaaggtggatggctctgtacaatgcctatgccatacaatgtctctcagaagaggaagtacaggcagtacatgaatcgaaaaggtggattcaacagaccttgggatttcatggcattgagaattgaagtgttgaaggatgattttttttcccctcatctgggtcagagagtggatcggtatacggcattcaactggcattcaaaaaaccaggatctcaagttctcctatcctgggtacggtaaggcaaaatcttaatccactggatcatatggccggtttacctttacccttgggcaacaaccaggacggaaaagggttaaaactatttaccatttagaagctattcagggcaactattcactcgcgggccagggggttaacccccatttcacttggcccatattccgttggaagccggataaagtaacgtaccggaaggctcataggactcctaacatattgaaagcattgggaggaagtatccataaagagattgaccctg

SEQ ID NO: 407777 - DNA, 853 bp, Homo sapiens
tgtcttttcatgtcacagccagtttttatccatggaggagggtatatagagaaaaggatctcatgtattgctctacttttttcttctagatacctgttaacttcttacgctttcatgatacatttatctagttctgttattcaagttaaagtattatacagttaagtctatggcagagtcagattcttttatgtgtctaactgttgcgaagtatagacttcttatatcttatatggtgaccattaacatataacgagcatgctagcatattgttgtctttgagagcaccgtatcaactttttgatctgtagaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtaagttttataccctagtcaaaatgaaaaatagcaaaaaccgcactgtaaaaaaaaaaaaaaattggtttcctttagtagatagtatttcaacccatcatattcttattataaataaacagaacaatcttaagttgacagatatcaaagagaccttgatctgattttggtgccaagtgaggtcttaattcctcttcctgccttaagtgcttggtgtcatacagtgggtggtacaaagctgttttatgcctaatattgctaaatgggacccttctaattgatttgaaagacattataacatattgtccagactttaagacttaaagagtaggaaatactacttttagtggctaaatttattcatttt

SEQ ID NO: 407778 - DNA, 1546 bp, Homo sapiens
tagtgcagttaattaaaaatatatcagactttttgctttaatgtgtacctttactgatgaggccagatagtctctagtcaggttaattttttacagatctagaaggattattattttactttatttttaacataaaatgatgtactgtgccactaaacatattgttaatttcaaatataggaagatttttttttaataaaaagcttggtaattagttactcttcaaattgtatttgtgtctttgattttctaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtctggtattaaatgtttcctctgtattctcagggtgaattaatgtagtaatatttaaaattacaaaatagatggttaactgttacactgtggcattggaattttaactcttggtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaag

SEQ ID NO: 407779 - DNA, 1779 bp, Homo sapiens
tgtcttttcatgtcacagccagtttttatccatggaggagggtatatagagaaaaggatctcatgtattgctctacttttttcttctagatacctgttaacttcttacgctttcatgatacatttatctagttctgttattcaagttaaagtattatacagttaagtctatggcagagtcagattcttttatgtgtctaactgttgcgaagtatagacttcttatatcttatatggtgaccattaacatataacgagcatgctagcatattgttgtctttgagagcaccgtatcaactttttgatctgtagaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtctggtattaaatgtttcctctgtattctcagggtgaattaatgtagtaatatttaaaattacaaaatagatggttaactgttacactgtggcattggaattttaactcttggtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcaaaaaaaaaag

SEQ ID NO: 407780 - DNA, 532 bp, Homo sapiens
gtagattattggtagcagtacatataaaagaagagcatattttagggcaggcgcagtagctcatgcctgtaatcccatcactttgggaggccgaggtgggtggatcacctgagttcaagagttcgagaccagcctggccaccatggtgaaaccctgtctctataatttttttttgtatttttagtagagacggggtttcaccatgttagccaggatggtctcggtctcctgaccttgtgatctgcccgccttggactcccaaagtgctgggattacaggcgtgagccatagttcctggcctgaccttgtctttcttaactttgggttcttccaataggggaggaggcggcagcaaagacatcttcacatcatcttgtatctaatgcccatttacttatgtgtgtctcccaaacagctatgaaatacacaagggcaggggattacctcggtatctccagatgagtgaaatgccatgcacatcttgatggttagtaaatatttattgaatggcaaatacttaaaatctgtgtaa

SEQ ID NO: 407781 - DNA, 2687 bp, Homo sapiens
gagtttcggtcttgttgcccaagctggagtgcaaaggcgtgatctcggctcaccgcaacctccacctcccgggttcaagcaattctcctgccttagcctcctgagtagctgggattacagacgcatgccaccacgcccggctcattttttgtatttttggtagagacagggtttcaccatgttggccaggctggtctcaaactcgtgatccgcccatctcagcctcccaaagtgttgagattacaggcatgagccaccgtacccggcctctttttttgttgtgtttgtgttttttgtcttagatttttttcttaatcaagtttttccagaagagagtagctttaggaagagaataaacacatacttttaaggtattatctcagactttaggcgcattatgatcatatcagtagcacccatgtactgaataagtgaactcaaagaaaagttatgttgggcaactacctcaaagttttgttatctctgcttgcaatttttgttcagtcattgcacaagtgcttgagggcttactgcatgtgaggctctgtagactaagtattaatgaactttcttttttgtccttgcagtagcaggtacagctttgatctcagttttctgccaaatgaatggttctgtgttttgtgctcattcgtttacagagatccctctgaaccaccttggaaccagaaggtgtgtggtctgagaacgataaatgggctgctctctgcctctctcacagcagttctgcccctccttgggaccactcgttttctgcattcctggcccatcttctatatatctctggtccagattccagaggaaacctgtttgacttgaatagatgccattgcccttattgggccttgcctcaggagttcctctgtgtatctctggtccagattccggaggaaacctgtttgacttgagtagatgccattgcccttattgggccttgcctcaggagttgctggttagcctatgaaggggttccctttgggttgatgacattgctcccatccagaaagtggctacttctaccctcctactcccaccactctgcatgcaggagctgttatcatcaaaagggaatgtccactgtctgctctgtaccagagaagtgctaggcttcataaatattggtaatcgatacctgaatgggatgaaaattggcaggtcctgggatggatggcctggttcatctgcatcagaactggaaaaacaaaatcacaccaaattgcagacttttttggaagagcgtgttagacaaggtttgtggattgtttgatttttaccaagaaagaaagctttctcctaagagggtaagatttctacttgagtgagctctaagaggagtcccagtttgcaagagatattattacagttctcatctgtgcggaccagaaagttttccaaattcatgcatttcagttatctaacagatatttactgagcatttaccatgttcagtaaccagggccctgggaatataataggagaaggcagatgagatccttgccttcaccaagcttatgtttttctattttaagtaaaatttgccatgacaaaatttctatcagcggaagagccagtaactcttattgtaataggttttacccagttttagaaaaggaaagtagctaaactcttggttccttggtgtgtgtttttgtttgttcatttctagtacttgtctatgtctttggggtaatttttgatttagaattttgtagaaattactcggcacagtgtagttgaggtgaatataggcaagaaggcttaggaagcctacaacaaaggaatctgacaccaacttttgagatttattcagtccagccaagagaatatatttatggtcaaactagatcttggattacagctccaaagacccttgggctgacagagcaggttctcatttctcagctctttcccttatcacttgcagtgaactctgcccccaggagcagagtatccagttctgtgtccaagcactctatgaatctttacccttgttgaagaaatactcagagacagaagcatttagaaaaggaaaagtttacctgcaaagagagcaagagaatgactggcttgcctaataaaaaacgtaagtatttgaaggaaaaaattaaaaactgccaaggtttctgagtttgcattagactgttcacggtgaaaaacagtaactgcctcatgtaattattgtattcataaaggttatggcaaatcttcagatgtagtacaggaaaaaccaaggataaaatttcttagggagtccaggtttatgggaaacattcaaggttttattgttttttagatcatcaacagttagatgaccctatcatttttgttttgtctcagggtgcaacgtctttcttttctgatggtgattgatatagtttggctgtgtccccacccaaatctcatcttgaattcccatgtgttgttggagggacctggtgggaggtaactaaatcatgggggcaagtctttcccgtgctgttcttgtgatagtgaggaagtctcacgagatcttttggttattataagagggagttttcctgcacaagccctcattttgcctgctgccatctatataagatgtgatttgctgctccttgccttccgccatgattgtgaagcctccccagccatgtggaactgtaagtccaataaacctcttttgtaaatta

SEQ ID NO: 407782 - DNA, 3083 bp, Homo sapiens
gagtttcggtcttgttgcccaagctggagtgcaaaggcgtgatctcggctcaccgcaacctccacctcccgggttcaagcaattctcctgccttagcctcctgagtagctgggattacagacgcatgccaccacgcccggctcattttttgtatttttggtagagacagggtttcaccatgttggccaggctggtctcaaactcgtgatccgcccatctcagcctcccaaagtgttgagattacaggcatgagccaccgtacccggcctctttttttgttgtgtttgtgttttttgtcttagatttttttcttaatcaagtttttccagaagagagtagctttaggaagagaataaacacatacttttaaggtattatctcagactttaggcgcattatgatcatatcagtagcacccatgtactgaataagtgaactcaaagaaaagttatgttgggcaactacctcaaagttttgttatctctgcttgcaatttttgttcagtcattgcacaagtgcttgagggcttactgcatgtgaggctctgtagactaagtattaatgaactttcttttttgtccttgcagtagcaggtacagctttgatctcagttttctgccaaatgaatggttctgtgttttgtgctcattcgtttacagagatccctctgaaccaccttggaaccagaaggtgtgtggtctgagaacgataaatgggctgctctctgcctctctcacagcagttctgcccctccttgggaccactcgttttctgcattcctggcccatcttctatatatctctggtccagattccagaggaaacctgtttgacttgaatagatgccattgcccttattgggccttgcctcaggagttcctctgtgtatctctggtccagattccggaggaaacctgtttgacttgagtagatgccattgcccttattgggccttgcctcaggagttgctggttagcctatgaaggggttccctttgggttgatgacattgctcccatccagaaagtggctacttctaccctcctactcccaccactctgcatgcaggagctgttatcatcaaaagggaatgtccactgtctgctctgtaccagagaagtgctaggcttcataaatattggtaatcgatacctgaatgggatgaaaattggcaggtcctgggatggatggcctggttcatctgcatcagaactggaaaaacaaaatcacaccaaattgcagacttttttggaagagcgtgttagacaaggtttgtggattgtttgatttttaccaagaaagaaagctttctcctaagagggtaagatttctacttgagtgagctctaagaggagtcccagtttgcaagagatattattacagttctcatctgtgcggaccagaaagttttccaaattcatgcatttcagttatctaacagatatttactgagcatttaccatgttcagtaaccagggccctgggaatataataggagaaggcagatgagatccttgccttcaccaagcttatgtttttctattttaagtaaaatttgccatgacaaaatttctatcagcggaagagccagtaactcttattgtaataggttttacccagttttagaaaaggaaagtagctaaactcttggttccttggtgtgtgtttttgtttgttcatttctagtacttgtctatgtctttggggtaatttttgatttagaattttgtagaaattactcggcacagtgtagttgaggtgaatataggcaagaaggcttaggaagcctacaacaaaggaatctgacaccaacttttgagatttattcagtccagccaagagaatatatttatggtcaaactagatcttggattacagctccaaagacccttgggctgacagagcaggttctcatttctcagctctttcccttatcacttgcagtgaactctgcccccaggagcagagtatccagttctgtgtccaagcactctatgaatctttacccttgttgaagaaatactcagagacagaagcatttagaaaaggaaaagtttacctgcaaagagagcaagagaatgactggcttgcctaataaaaaacgtaagtatttgaaggaaaaaattaaaaactgccaaggtttctgagtttgcattagactgttcacggtgaaaaacagtaactgcctcatgtaattattgtattcataaaggttatggcaaatcttcagatgtagtacaggaaaaaccaaggataaaatttcttagggagtccaggtttatgggaaacattcaaggttttattgttttttagatcatcaacagttagatgaccctatcatttttgttttgtctcagggtgcaacgtctttcttttctgatggtgattgatatagtttggctgtgtccccacccaaatctcatcttgaattcccatgtgttgttggagggacctggtgggaggtaactaaatcatgggggcaagtctttcccgtgctgttcttgtgatagtgaggaagtctcacgagatcttttggttattataagagggagttttcctgcacaagccctcattttgcctgctgccatctatataagatgtgatttgctgctccttgccttccgccatgattgtgaagcctccccagccatgtggaactgtaagtccaataaacctcttttgtaaattacctaatctcaggtctgtctttatcaacagcatgaaaacagactaatagaatgatataggaagttcttagtcttactgaagcaagggaaagtgacattttgcttctacaccctccagaattcataagctccagaaggaaagaggacccaagggaaaaacgtgattgcaaaatgtgttcttgtcctctgcccaagtgattaacctttgctccagtggttttcaaacctggctgctgttagaatcacctggcagtgtttaaaaatgactgatgcccagcattttaacttaaataccaatttggtctggagtggagcctgagtatggatatttaaaaaagtaactcctcctccccaatcccccgtaattgtaatgtgcagccaagattgagaaccactgc

SEQ ID NO: 407783 - DNA, 2433 bp, Homo sapiens
gagtttcggtcttgttgcccaagctggagtgcaaaggcgtgatctcggctcaccgcaacctccacctcccgggttcaagcaattctcctgccttagcctcctgagtagctgggattacagacgcatgccaccacgcccggctcattttttgtatttttggtagagacagggtttcaccatgttggccaggctggtctcaaactcgtgatccgcccatctcagcctcccaaagtgttgagattacaggcatgagccaccgtacccggcctctttttttgttgtgtttgtgttttttgtcttagatttttttcttaatcaagtttttccagaagagagtagctttaggaagagaataaacacatacttttaaggtattatctcagactttaggcgcattatgatcatatcagtagcacccatgtactgaataagtgaactcaaagaaaagttatgttgggcaactacctcaaagttttgttatctctgcttgcaatttttgttcagtcattgcacaagtgcttgagggcttactgcatgtgaggctctgtagactaagtattaatgaactttcttttttgtccttgcagtagcaggtacagctttgatctcagttttctgccaaatgaatggttctgtgttttgtgctcattcgtttacagagatccctctgaaccaccttggaaccagaaggtgtgtggtctgagaacgataaatgggctgctctctgcctctctcacagcagttctgcccctccttgggaccactcgttttctgcattcctggcccatcttctatatatctctggtccagattccagaggaaacctgtttgacttgaatagatgccattgcccttattgggccttgcctcaggagttcctctgtgtatctctggtccagattccggaggaaacctgtttgacttgagtagatgccattgcccttattgggccttgcctcaggagttgctggttagcctatgaaggggttccctttgggttgatgacattgctcccatccagaaagtggctacttctaccctcctactcccaccactctgcatgcaggagctgttatcatcaaaagggaatgtccactgtctgctctgtaccagagaagtgctaggcttcataaatattggtaatcgatacctgaatgggatgaaaattggcaggtcctgggatggatggcctggttcatctgcatcagaactggaaaaacaaaatcacaccaaattgcagacttttttggaagagcgtgttagacaaggtttgtggattgtttgatttttaccaagaaagaaagctttctcctaagagggtaagatttctacttgagtgagctctaagaggagtcccagtttgcaagagatattattacagttctcatctgtgcggaccagaaagttttccaaattcatgcatttcagttatctaacagatatttactgagcatttaccatgttcagtaaccagggccctgggaatataataggagaaggcagatgagatccttgccttcaccaagcttatgtttttctattttaagtaaaatttgccatgacaaaatttctatcagcggaagagccagtaactcttattgtaataggttttacccagttttagaaaaggaaagtagctaaactcttggttccttggtgtgtgtttttgtttgttcatttctagtacttgtctatgtctttggggtaatttttgatttagaattttgtagaaattactcggcacagtgtagttgaggtgaatataggcaagaaggcttaggaagcctacaacaaaggaatctgacaccaacttttgagatttattcagtccagccaagagaatatatttatggtcaaactagatcttggattacagctccaaagacccttgggctgacagagcaggttctcatttctcagctctttcccttatcacttgcagtgaactctgcccccaggagcagagtatccagttctgtgtccaagcactctatgaatctttacccttgttgaagaaatactcagagacagaagcatttagaaaaggaaaagtttacctgcaaagagagcaagagaatgactggcttgcctaataaaaaacggtgcaacgtctttcttttctgatggtgattgatatagtttggctgtgtccccacccaaatctcatcttgaattcccatgtgttgttggagggacctggtgggaggtaactaaatcatgggggcaagtctttcccgtgctgttcttgtgatagtgaggaagtctcacgagatcttttggttattataagagggagttttcctgcacaagccctcattttgcctgctgccatctatataagatgtgatttgctgctccttgccttccgccatgattgtgaagcctccccagccatgtggaactgtaagtccaataaacctcttttgtaaatta

SEQ ID NO: 407784 - DNA, 2379 bp, Homo sapiens
gagtttcggtcttgttgcccaagctggagtgcaaaggcgtgatctcggctcaccgcaacctccacctcccgggttcaagcaattctcctgccttagcctcctgagtagctgggattacagacgcatgccaccacgcccggctcattttttgtatttttggtagagacagggtttcaccatgttggccaggctggtctcaaactcgtgatccgcccatctcagcctcccaaagtgttgagattacaggcatgagccaccgtacccggcctctttttttgttgtgtttgtgttttttgtcttagatttttttcttaatcaagtttttccagaagagagtagctttaggaagagaataaacacatacttttaaggtattatctcagactttaggcgcattatgatcatatcagtagcacccatgtactgaataagtgaactcaaagaaaagttatgttgggcaactacctcaaagttttgttatctctgcttgcaatttttgttcagtcattgcacaagtgcttgagggcttactgcatgtgaggctctgtagactaagtattaatgaactttcttttttgtccttgcagtagcaggtacagctttgatctcagttttctgccaaatgaatggttctgtgttttgtgctcattcgtttacagagatccctctgaaccaccttggaaccagaaggtgtgtggtctgagaacgataaatgggctgctctctgcctctctcacagcagttctgcccctccttgggaccactcgttttctgcattcctggcccatcttctatatatctctggtccagattccagaggaaacctgtttgacttgaatagatgccattgcccttattgggccttgcctcaggagttcctctgtgtatctctggtccagattccggaggaaacctgtttgacttgagtagatgccattgcccttattgggccttgcctcaggagttgctggttagcctatgaaggggttccctttgggttgatgacattgctcccatccagaaagtggctacttctaccctcctactcccaccactctgcatgcaggagctgttatcatcaaaagggaatgtccactgtctgctctgtaccagagaagtgctaggcttcataaatattggtaatcgatacctgaatgggatgaaaattggcaggtcctgggatggatggcctggttcatctgcatcagaactggaaaaacaaaatcacaccaaattgcagacttttttggaagagcgtgttagacaaggtttgtggattgtttgatttttaccaagaaagaaagctttctcctaagagggtaagatttctacttgagtgagctctaagaggagtcccagtttgcaagagatattattacagttctcatctgtgcggaccagaaagttttccaaattcatgcatttcagttatctaacagatatttactgagcatttaccatgttcagtaaccagggccctgggaatataataggagaaggcagatgagatccttgccttcaccaagcttatgtttttctattttaagtaaaatttgccatgacaaaatttctatcagcggaagagccagtaactcttattgtaataggttttacccagttttagaaaaggaaagtagctaaactcttggttccttggtgtgtgtttttgtttgttcatttctagtacttgtctatgtctttggggtaatttttgatttagaattttgtagaaattactcggcacagtgtagttgaggtgaatataggcaagaaggcttaggaagcctacaacaaaggaatctgacaccaacttttgagatttattcagtccagccaagagaatatatttatggtcaaactagatcttggattacagctccaaagacccttgggctgacagagcaggttctcatttctcagctctttcccttatcacttgcagtgaactctgcccccaggagcagagtatccagttctgtgtccaagcactctatgaatctttacccttgttgaagaaatactcagagacagaagcatttagaaaaggaaaagtttacctgcaaagactgatggtgattgatatagtttggctgtgtccccacccaaatctcatcttgaattcccatgtgttgttggagggacctggtgggaggtaactaaatcatgggggcaagtctttcccgtgctgttcttgtgatagtgaggaagtctcacgagatcttttggttattataagagggagttttcctgcacaagccctcattttgcctgctgccatctatataagatgtgatttgctgctccttgccttccgccatgattgtgaagcctccccagccatgtggaactgtaagtccaataaacctcttttgtaaatta

SEQ ID NO: 407785 - DNA, 2390 bp, Homo sapiens
gagtttcggtcttgttgcccaagctggagtgcaaaggcgtgatctcggctcaccgcaacctccacctcccgggttcaagcaattctcctgccttagcctcctgagtagctgggattacagacgcatgccaccacgcccggctcattttttgtatttttggtagagacagggtttcaccatgttggccaggctggtctcaaactcgtgatccgcccatctcagcctcccaaagtgttgagattacaggcatgagccaccgtacccggcctctttttttgttgtgtttgtgttttttgtcttagatttttttcttaatcaagtttttccagaagagagtagctttaggaagagaataaacacatacttttaaggtattatctcagactttaggcgcattatgatcatatcagtagcacccatgtactgaataagtgaactcaaagaaaagttatgttgggcaactacctcaaagttttgttatctctgcttgcaatttttgttcagtcattgcacaagtgcttgagggcttactgcatgtgaggctctgtagactaagtattaatgaactttcttttttgtccttgcagtagcaggtacagctttgatctcagttttctgccaaatgaatggttctgtgttttgtgctcattcgtttacagagatccctctgaaccaccttggaaccagaaggtgtgtggtctgagaacgataaatgggctgctctctgcctctctcacagcagttctgcccctccttgggaccactcgttttctgcattcctggcccatcttctatatatctctggtccagattccagaggaaacctgtttgacttgaatagatgccattgcccttattgggccttgcctcaggagttcctctgtgtatctctggtccagattccggaggaaacctgtttgacttgagtagatgccattgcccttattgggccttgcctcaggagttgctggttagcctatgaaggggttccctttgggttgatgacattgctcccatccagaaagtggctacttctaccctcctactcccaccactctgcatgcaggagctgttatcatcaaaagggaatgtccactgtctgctctgtaccagagaagtgctaggcttcataaatattggtaatcgatacctgaatgggatgaaaattggcaggtcctgggatggatggcctggttcatctgcatcagaactggaaaaacaaaatcacaccaaattgcagacttttttggaagagcgtgttagacaaggtttgtggattgtttgatttttaccaagaaagaaagctttctcctaagagggtaagatttctacttgagtgagctctaagaggagtcccagtttgcaagagatattattacagttctcatctgtgcggaccagaaagttttccaaattcatgcatttcagttatctaacagatatttactgagcatttaccatgttcagtaaccagggccctgggaatataataggagaaggcagatgagatccttgccttcaccaagcttatgtttttctattttaagtaaaatttgccatgacaaaatttctatcagcggaagagccagtaactcttattgtaataggttttacccagttttagaaaaggaaagtagctaaactcttggttccttggtgtgtgtttttgtttgttcatttctagtacttgtctatgtctttggggtaatttttgatttagaattttgtagaaattactcggcacagtgtagttgaggtgaatataggcaagaaggcttaggaagcctacaacaaaggaatctgacaccaacttttgagatttattcagtccagccaagagaatatatttatggtcaaactagatcttggattacagctccaaagacccttgggctgacagagcaggttctcatttctcagctctttcccttatcacttgcagtgaactctgcccccaggagcagagtatccagttctgtgtccaagcactctatgaatctttacccttgttgaagaaatactcagagacagaagcatttagaaaaggaaaagtttacctgcaaagagagcaagagaatgactggcttgcctaataaaaaacctatgaaatacacaagggcaggggattacctcggtatctccagatgagtgaaatgccatgcacatcttgatgggctgattactggacaaatgggatcacataaagctaaaaagcttctgcacagtaaaggaaataatcaacaaagtgaagagacaacccatagaatgggagaaattatttgcaaactacccatctaacatgggattaataaccagaatatgtaaggaactcaaacaactcagtaggaaaaaaacaaataattcgattaaaaatgcacaaaaggtctgaa

SEQ ID NO: 407786 - DNA, 778 bp, Homo sapiens
cttctacattttggctgttgttaatacgctgctgtgaatgtgggtgtacaactgtgtctttgagatcttgttttcagttcttttgagatatatacccataagtggaattgctggatcttatggtaattctatttttaatattttgttgtgtttgtgttttttgtcttagatttttttcttaatcaagtttttccagaagagagtagctttaggaagagaataaacacatacttttaaggtattatctcagactttaggcgcattatgatcatatcagtagcacccatgtactgaataagtgaactcaaagaaaagttatgttgggcaactacctcaaagttttgttatctctgcttgcaatttttgttcagtcattgcacaagtgcttgagggcttactgcatgtgaggctctgtagactaagtattaatgaactttcttttttgtccttgcagtagcaggtacagctttgatctcagttttctgccaaatgaatggttctgtgttttgtgctcattcgtttacagagatccctctgaaccaccttggaaccagaaggtgtgtggtctgagaacgataaatgggctgctctctgcctctctcacagcagttctgcccctccttgggaccactcgttttctgcattcctggcccatcttctatatatctctggtccagattccagaggaaacctgtttgacttgaatagatgccattgcccttattgggccttgcctcaggagttcctctgtgtatctctggtccagattccggaggaa

SEQ ID NO: 407787 - DNA, 281 bp, Homo sapiens
attttgttttaaaattatatatatataattaatacaaaattcgaagaacatataaaatctgctagttgttcattgcttccatgatagcattactaggatctttaactttctatatttttctgtttgaatttttactacaaacatttatatacattattttgtaataaataagataaaaagaataaaataggtaaattcctttctattaactaatttctagcatcactgacattgatgtactctcattttgtaagtttccataataaagctatttgaattct

SEQ ID NO: 407788 - DNA, 441 bp, Homo sapiens
actaaacccaaactgaatatatccttaatttaaaatccctttagccacatcccaaaattccctgggccactaaatgccacatgatatggatggatgctgatggaggggaagtcagtatagaaagggatcctggttttacttttacaaattttacaaaaacatatgacaaggtgaatacattgtttaagcaccataattaatctcttcatgcccaattacccacacttgtgtagaccatacacatttaaaaatgactaagtggtcctgaatctttttatacagcttcttgaagggaaacaaagcaatgatttcttaaatcattaatccctatttacaatgaacctgaatagattgacaaatttatccaaaagaaaaagaaagaaaagaaaagaaagaaagaaagaaagaaagaaagaaagaaagaaagaaagaaagaaagag

SEQ ID NO: 407789 - DNA, 776 bp, Homo sapiens
agccagaaagattaaagctctccctgctgaaatctcctttccctccagcaggaaaccagtgtagttatgttgtttgtacttgccaggatacacttccatttcatatttgcaagtacacataaaggtatccttcatcagcagcacagtgcttcctttcctctgaatctgccatcagctcaggcagatttctaagcagcaaatcagcctttgccagaacactgcaggacaccagtgcagcgcccagcctgcgaccatgagaaaccccagccacatctccagcacacaagaacttcaaaatgcctaagccgcagcagtcaagcattcctagaggacctttctccatcaggatcttgcttcaagtgccagaaatctggccactgggccaaggaatgcccacagcccgggattcctcctaagctgtgtcccatctgtgtgggaccccactgaaaatcagactgtccagctcacctggcagccactcccagagcccctggaactctggcccaaggctctctgattgacttcttcccagatcttctgggcttagtggctgaagactgacactgcccgatcacctgagaagcctcctggaccatcacagatgctttaggtaactcttacagtagagggctctaggggatggtagagtcacaggatggaagaactctgtgtccttgaatcattgcatggaagagaactggaagttgcccaggaacaccagccttggacagttatgtgaacaagaaataaacttcttttacagtgtcaaaaaaaat

SEQ ID NO: 407790 - DNA, 634 bp, Homo sapiens
agccagaaagattaaagctctccctgctgaaatctcctttccctccagcaggaaaccagtgtagttatgttgtttgtacttgccaggatacacttccatttcatatttgcaagtacacataaaggtatccttcatcagcagcacagtgcttcctttcctctgaatctgccatcagctcaggcagatttctaagcagcaaatcagcctttgccagaacactgcaggacaccagtgcagcgcccagcctgcgaccatgagctcgcctgcacccaggtgattaaaaagctttattgctcacacaaagcctgtttggtggtctcttcacatggacgcgagtgacatttggtgccgtgactcggatcggggaacctcccttgggagatcaatcccctgtcctcctgctctttgttccaagagaaagatccacctacgacctctgctcctcagaccaaccagcccaaggaacatctcaccaattttaaatcgggctctaggggatggtagagtcacaggatggaagaactctgtgtccttgaatcattgcatggaagagaactggaagttgcccaggaacaccagccttggacagttatgtgaacaagaaataaacttcttttacagtgtcaaaaaaaat

SEQ ID NO: 407791 - DNA, 405 bp, Homo sapiens
agccagaaagattaaagctctccctgctgaaatctcctttccctccagcaggaaaccagtgtagttatgttgtttgtacttgccaggatacacttccatttcatatttgcaagtacacataaaggtatccttcatcagcagcacagtgcttcctttcctctgaatctgccatcagctcaggcagatttctaagcagcaaatcagcctttgccagaacactgcaggacaccagtgcagcgcccagcctgcgaccatgaggctctaggggatggtagagtcacaggatggaagaactctgtgtccttgaatcattgcatggaagagaactggaagttgcccaggaacaccagccttggacagttatgtgaacaagaaataaacttcttttacagtgtcaaaaaaaat

SEQ ID NO: 407792 - DNA, 1632 bp, Homo sapiens
agccagaaagattaaagctctccctgctgaaatctcctttccctccagcaggaaaccagtgtagttatgttgtttgtacttgccaggatacacttccatttcatatttgcaagtacacataaaggtatccttcatcagcagcacagtgcttcctttcctctgaatctgccatcagctcaggcagatttctaagcagcaaatcagcctttgccagaacactgcaggacaccagtgcagcgcccagcctgcgaccatgaggcattttaaaatctgtggcgcttccagactcatatcaacattccctgatggaagcctttagcaatcctaaccaggaagtggccagagcctggagccagagacgaacgtccctcataggaggggttgctggaggaggaggggcaaatctatttcattctgtccttgcaggcacattttcatcagttaatgatgcaaaccaggctgaaacgttcttaacaagcatgtgtgtttctgtttttcatttgaaagtcaggagcatgaggctatattcatcatagaggcagggtttctctgtgtcagagctcagcattggcagctctagcaaaggacaggctgcatttagctggttcttttctaaggagccacagtcaggcactaaaccagcatctacacctctgaggcccctaaaagcctccagtgaagctgggcttgatcagacctcaaaaagatctccctttgcattttgctcttagttctcagtgatctttaaaaaataataataataaaaagattagaatcatgaaagatttttctcaggatatgaatactataggcacactaaagaaactttggaaaaatgccagcaagtataagcgaaaaaaaatcatactgccccttatatcacccactgaaattaaaatatttaaacattatgcttctgtgtacacctgtatacgctatatgtcaggcctctgagcccaagctaagccatcatataccctgtgacctgcacgtataaatccggatgacctgaagtaactgaagaatcacaaaagaagtgaaaatggcctgtccctgccttaactgatgacattaccttgtgaaattccttctcccagctcttcctggctcaaaagctcccccactgagcaccttgtgccccccacccctgccagccagagaacatccgcctttgactgtaattttccactatctacccaaatcttataaaaacagcccatcccatctcccttcactgactctctttttggactcagctcgcctgcacccaggtgattaaaaagctttattgctcacacaaagcctgtttggtggtctcttcacatggacgcgagtgacatttggtgccgtgactcggatcggggaacctcccttgggagatcaatcccctgtcctcctgctctttgttccaagagaaagatccacctacgacctctgctcctcagaccaaccagcccaaggaacatctcaccaattttaaatcgggctctaggggatggtagagtcacaggatggaagaactctgtgtccttgaatcattgcatggaagagaactggaagttgcccaggaacaccagccttggacagttatgtgaacaagaaataaacttcttttacagtgtcaaaaaaaat

SEQ ID NO: 407793 - DNA, 588 bp, Homo sapiens
agccagaaagattaaagctctccctgctgaaatctcctttccctccagcaggaaaccagtgtagttatgttgtttgtacttgccaggatacacttccatttcatatttgcaagtacacataaaggtatccttcatcagcagcacagtgcttcctttcctctgaatctgccatcagctcaggcagatttctaagcagcaaatcagcctttgccagaacactgcaggacaccagtgcagcgcccagcctgcgaccatgagcctgtttggtggtctcttcacatggacgcgagtgacatttggtgccgtgactcggatcggggaacctcccttgggagatcaatcccctgtcctcctgctctttgttccaagagaaagatccacctacgacctctgctcctcagaccaaccagcccaaggaacatctcaccaattttaaatcgggctctaggggatggtagagtcacaggatggaagaactctgtgtccttgaatcattgcatggaagagaactggaagttgcccaggaacaccagccttggacagttatgtgaacaagaaataaacttcttttacagtgtcaaaaaaaat

SEQ ID NO: 407794 - DNA, 538 bp, Homo sapiens
  misc_feature (16)..(16): n is a, c, g, or t
gaatggcttggtgctntgtagttatgctgcctggggggaaaaaagagtacagaatattcggtgagaactgaaggttattataatccagaaagagtgatggagtataaagacaacgtcttttcaaatagactttgcaagactttctgccttttcagtggtaaaggctaagcagtggtttgctggctttgccctctgtgggttacagaaaggcctttgcttataaatccatggagctgaaggtcacatgaagggcttgcctgcactagcttatttactctaggatcagaatcaagacctcagttaatctcagttacactagtgtggcatatttcccacctccacccatatccacccactagttctggccccagattgtctctgagctggccctgcccactggtcagaacagattggcaaatgatcattccttaggacagccctggcttgtacaacaggcaggaatgaggtcagaagaaaggctattgtccccatatccttggtagatggaggcttatgttaccttctcatgttgctttaa

SEQ ID NO: 407795 - DNA, 576 bp, Homo sapiens
acaggcaggtgcccaggcaactctcccaggcaaccatggttggcaggtcccaatttctactgagatcaccccacgtaggtcacatggcgagggtcccacaccccagcctcaccacttccaacgagccaaacgcttcccatttccagcccgacgatggtactaacttccctgcccctccttggagatccccaaccccaaataacctctcctgatctccagggtctcttggtgacaatacctgcctgcctgccttagctaagggggtcagttgcttctatcagtctcaatgccccagaaactgagcgaaaacccaagtattcatggcctactgaacgcaaagtctgagtctgaccctgggtattctattccttggtttttagaatgcccccagacaaagatgagggctgaaggctcagaaaggccgggtcaggccaggtgaggtggctcacgtctgaaatcacagcacttttggaggccgaggcaggaggatcctttgagtccacctcccaaagtgctgggattataggcgtgagccaccgcaccgggccttgatttcacatttgaactctcccacat

SEQ ID NO: 407796 - DNA, 463 bp, Homo sapiens
gggattttaggcttcttggggtgggaaactgagaaggtaaatatatggagaaaacgaatggagtaaggcttgttggcagagtcctctgctgctgtccctaggctaagagtctagagttgtctccagtagaggagaagttctatcctatctttaggcagaaagtggggaggggagagagagagcttttcctcagtttgctgctgccttttatttttatttttaagcaaccctattaactgagctgcttcttaattgctttcagctcaaaaataatttttatatcaaagaagcatattttaggtgacatattctagttcccttcatttcctagtcagacttttaacaaactgtttagttgattaaattgtaaacattctaactagaatatttaattttccctatagacttcatagccttcagacttttttttttttttttttgagacagggtctaactctgtcac

SEQ ID NO: 407797 - DNA, 554 bp, Homo sapiens
cgcctgcgcggacgtcgatgggtttgtgggcgcagggcgcgaggcgcgaggcggtagctgggctagtcctgttccctggcgtctgggcctttctgctctccgcaaggagctgggtcgcgacctgtcactgccagccgtgcgctcgccctctgcgccccgtctcgtggtcactgccgccctccctcccgccacacctgtgatgatcgctatggagccgcgcctcaggtggcattactataaacctaagaggagaggcgcccgttcgaataagggcaaattatttagtattttgtcttcaatgttcctggcagcttaaagtaccaactgggacacttgtcactagtttgagaagtgcagccatagtgacctcttttgaaagatgaatcaatgaattaagtcatttctgagaaaccaaggaggcctgttgaaggaggctggccctcctgtggcaggtaacccaacctccactgcccttggcaacaggacaaggctaatattttcccaagaagggccttttcatggaatgatctttccaacccgttgactacaacaag

SEQ ID NO: 407798 - DNA, 713 bp, Homo sapiens
cgcctgcgcggacgtcgatgggtttgtgggcgcagggcgcgaggcgcgaggcggtagctgggctagtcctgttccctggcgtctgggcctttctgctctccgcaaggagctgggtcgcgacctgtcactgccagccgtgcgctcgccctctgcgccccgtctcgtggtcactgccgccctccctcccgccacacctgtgatgatcgctatggagccgcgcctcaggtggcattactataaacctaagaggagaggcgcccgttcgaataagggcaaattatttagtattttgtcttcaatgttcctggcagcttaaagtaccaactgggacacttgtcactagtttgagaagtgcagccataggtgagttctctccaccccaactttcttagtcatcctgccctgaacaaatcagctcaagccagtcccccgccagtgccactttccacttgtctccattgaaaccttcaccctccttcaaggcccaccaccagcccttcgcagatgcccacctccccagcctctacagccctttgtttccatcagtccctctccctggctcagtctctgctttcataaggagccggctctctgttcacccagatttaacttgctcagaggcagaaacttaggcttctttgtatgctcccaatgcttagttccatactgggaacaaagtaggtgtccggtatttttttactggtttcccttta

SEQ ID NO: 407799 - DNA, 1577 bp, Homo sapiens
ggcggagctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagtgagcccccagcccagcccctgcctcttgctttcctggggctctgcatcagcacctgatgccctgggagaaagtctcccctcccagggtggagatcctggcccagagagcccactgccaggccggggggaggggggagcagcagccccgctgggagggaaaggatggcagacacacagctgtgtgagagccccatgagtgtgtgtgggcacctgcacctgaccgtgagtgtggtgtatgtgtgtgtcgctggccactccgatgggagtgctcgccactcctgctcctccctgttcgtccttgcaggttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgca

SEQ ID NO: 407800 - DNA, 1117 bp, Homo sapiens
actctagacgatccctgagacggtacccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgca

SEQ ID NO: 407801 - DNA, 1646 bp, Homo sapiens
ggcggagctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgcaaaaaaaaaagaaaaaaaacacagaaaccagacgagaacacacagagagaaaagaacaaaaacagggtgacgggccaataagaaaacccccaggaggggcgcaaggaagagagcgtcaccaccagattgatagagacgcgagaggggcggcaccgaataagaagggggggacccataatataaagcaaagccgaagcgagcgggagaatggtatacagcaccgcttcggcagcagaagaaataacaagacgaagagaggcgactttgtggagaagaagcccaatactctagtggggggcgacaacaaatgggggggacctcacaacaaagagatataccagcgcggggggagaaatacaagagtagaggaggatcg

SEQ ID NO: 407802 - DNA, 1378 bp, Homo sapiens
ggcggagctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgcacacctgggggtctgccgcaggcagtcatcactggccttcccatgtgccccccaggaccatgtggtgtgtctggggcatcagggcaccaggtgaccatggacgtgttg

SEQ ID NO: 407803 - DNA, 1271 bp, Homo sapiens
ggcggagctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgca

SEQ ID NO: 407804 - DNA, 867 bp, Homo sapiens
actagtccacggttggctattggttgaatgagtaggctgatggtttcgataataactagtatggggataaggggtgtaggtgtgccttgtggtaagaagtgggctagggcatttttaatcttagagcgaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgca

SEQ ID NO: 407805 - DNA, 1217 bp, Homo sapiens
ggcggagctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggttcttcagctctgagcagtacagaacaggaaagcccatccctggtgatcgcctatgggcaaggcagcagcgaaggcctgagacagaatgtggacgtgtggctgtggcagctggcaagtggggcccagggacagggttgcagaaccccctgccagagggcatcagcccgctcctcggccctgggctcccacacggggcccactcttggggccttggggcccaggcagactcagacattcacccaggtgatgaggcccaacagtctccatttgattctcctgctcctcttctccaggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgca

SEQ ID NO: 407806 - DNA, 1119 bp, Homo sapiens
ggcggagctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacagactcagtgcagcacttccacaccaagaaggccctcaataaaggcttcctgaggaacgcacacctgggggtctgccgcaggcagtcatcactggccttcccatgtgccccccaggaccatgtggtgtgtctggggcatcagggcaccaggtgaccatggacgtgttg

SEQ ID NO: 407807 - DNA, 1231 bp, Homo sapiens
agatgagggaggtggcaacagtgacaactgaacccagagctgttagacaccaaactaggaaagcagctctggagcccgagctgagctgagctccatggaagagtgaggaggaggtgtccataagagaagccctgagaccagacagaggaggaggacatgcctgtgaggaaagtggtctttccagaaactcagaagggaggaggtgatgtgtatgacagggctgggattgggatggagaatgtgaatttgggagagacggcagatgaaatcaggggtgtgggggaaacaacatttggtggaaagagttgacatgaggacatgtttgtgacatacgtactaataaacatggaattctagggtcttaagagtgttcaggggaacaggcttcgcctagctaagtgctcatgggcctccttttcacttgcggttctgcatttccttttacttatttttttcccaactctatcgaggtgtgattgacaaatgaaattgtaacaaaggtgtacaaagtgctgaattgatacatgtatgtattgtgacatgattaccacacaagttagtgaacacatctgtcacctcaccttgttgcttgtgtgtgtagtgagagcagttgagacctactgttagcacatttcaggtgtacagtattgttgactctagtcaccttgccgtccattagagccccagaacttacctagtcaagtagagaggttgggctctgccttttaacgagtcttaaccactaggagggcatttctgcatttcagaacagaattgcatattagctgatgctttcgtgttgcatcatagagcagcacttctcaccgcactccttggaaccctcagggcagggtttgcttcagagggcaggtgagaccaaaagagctggccgttagctgcagcgtttgcctttcacttgtgtaagctgtcccttaaaaaggaagagccgcctggcgcggtggctcatgcctgtaatcccagcactttgggaggccgaggtgggcagatcacaaggtcgagagagcgagaccatcctggccaaccaatatggtaaaaccccatctctactaaaaatacaaaaatcagctgggcgtagtggtgtgtgcctgtagtcccagctactggggaggctgagacaggagaatcacttgaacccgggaggcggaggttgcggtgagccaagattgcgccactgcactccagcctgggtgacagagtgagactccttcta

SEQ ID NO: 407808 - DNA, 380 bp, Homo sapiens
aacaaattatacttgaaaccacagggtttaatacaaagcagcataaaagtaagtattaaatttgtggcacagcctgcaagttgtgctaaacaattagaaggagagggagaaggagaaataatttgaacaaggcatagtttttaggaaaatacatgaattataaaatcttttaaaagtgtttgcctgttttcagtgagctaattaccttatctcaattaagtaatttgaagctatttagcactataaagagagaagaatataagaccaaaataataataaaatatatggaagttattgaaatgtgataacaaatagcaaatattaaagttaatccaaccatatctgtgaccatattaagtgtgaggaaattaaactttagc

SEQ ID NO: 407809 - DNA, 283 bp, Homo sapiens
taaaacaatattcatgttagaacacgttaaaactctatttcttccgtgcaaagtttagaactttaaaggtaattctgaaaatttgtttatgggggaaaatttttatttatttatttatttttttgagccgagatcgtgccactgcactctttttagcctgggcaacaacagtgaactccatctcaaaataaataaataaataaataaaataataatactttttttttccatttaaaattttctcagtttctcctaggtgtgcagtgcgctctcattgtcaggg

SEQ ID NO: 407810 - DNA, 604 bp, Homo sapiens
cattgttaatcaaaatctaagtgtcatgatgtcccttgtcaccaggaagtctcactcccaggtagtgctgtcccatgttgatgagggaggaggaaatgtctcagtgaggaattttaagagttcccaaaagctgacttaggatggcatcacagagtggcagaaatgagacctcagttaagtcattgatttatgtaagtcattgcttgttgaatcatccctagtctttggaatcccatgattttagtttcctccaaagtaaaacaatgagagatacataacattaagaatttgtattgcagaaatataatgcacacattgactacaatcaaaaagtgaatttacatgtcagaatgaaaaaagaacctattcattagggagccaacaacaaaatcttgaaaaaaattaaaacctggttcttctttacagactggttgtagccaggaaataattcaggatttagtccaagtggtagacaaataagaaaactcaaaaacaatggtcaggctagaatctaataacaggtgtgttatagttttcttatgaaacgtgatttttctgtctctagtctcccttttatttttttaaaatacataattatatatat

SEQ ID NO: 407811 - DNA, 1269 bp, Homo sapiens
cctcaagtgatccacctttctcggcctcccaaagtgctgggattacaggcgtgagccactccgcctggccttctgtgcccttctctttgggattcatcccatactcactggactgcacaggcctcttttcctggttctctggccagaaacacaaggtttcttacagagttttagccagcttttctactgcactactgggcaggtctggaattggtgcaaagccaggagagcaaaagggtgaaaaaaaaaataggaaacttatcccctgtaccagtcttgtctgcaagttttgactccccttcgtgccacctgcttttgtttggttttcagagtcctcaagtagctgctttcatatttgatgcagagttttcactgtaattatcaggagacacagcctgtcttggcttacctcaccatgccagaactccctggaatgctctctttttgatcacaggcgggcctttccccccatcagatgctcttaagagccctctgtcaatgcaggttttgggttattaggcacctgtgaaggtgtgggtttcttgggaaggaactgtctgaggaactctaaggtccttagagagaagtgtcatggatctcttctccctcctgttataaaagacagaaacccaatcccagctggcttaagaaggaaagaacacttgctggcgtctgaccaggagggcaggagtgttgccagggattcttctcatctctgggcattgcttccctgtgctgagttcatctcaggcagtcccctccaggggctgacaaggtgactcaccttggccttcatccctccagtttaacaaccccagaggacagcaggtagcttttcttcagtagttccagcaaacgtcccaaagctcacactggaccagtgagggtcacgtgcttatctctgaatcagttcctgaggctaagggcatggaatatgctgcttggccagcctggatcagatgctcagcccagggccagcgggggtagggatgtcagttcacctggacctcaggggctgacaagggggatactaaagtatgcattctcggccaggcgcggtggcacatgcctgtaatccctgcactttgggaggcccaggcaggcagatcacttgaggtcaggagtttgagaccagcctggccaacatggtgaaaccccatctctactaaaaatacaaaaattagccaggtgtggtggtgcacacttgtaatgccagctacttggaaggcttaggcaggagaattgcttgattccatctcaaaaaaaaaa

SEQ ID NO: 407812 - DNA, 335 bp, Homo sapiens
tcaaacttgcatctatacccaacctatggttgtaattgaccggacaagtatagtttacatgtgaatgttggttggtatttttgtttacattagtgagaaagatgaaagtgaaattacccaagatgtgttgaaacttcatgcattcatcagcgatgtgagtggctttgttgaattggataatagttttggaatactggaagagtatttcttcaacattttttgtgctattcacagtgtgacagctatagacatgatatattttaaagtttcatctgtagtattgtcatattttccatgtctttcttaagtctaggcaataaacaaaacaataaaca

SEQ ID NO: 407813 - DNA, 575 bp, Homo sapiens
ttactggatttctttttctcctgattttcggcctcagctcctagagtggcctcagctaggtaaccaacgggagtcgacttatctatgccaggcctgcagtttcacatctgtgacgggatgggacaaatgacaccgtggtattcgatgacagctcccaggtatttcaaggttggcccttactcattcagggggtatgtttgagtgccacggtgtgcccagactctgctaggcaccagagagacaagatacgagtgacgtggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatcccagcactgtagaaggcagaggccggcagatcacttgagcccaggagttggagaccagactggggaacatggcaagaccccatctctacaaaaaaattaaaaaatttggcctggtgtggtggctcatgcct

SEQ ID NO: 407814 - DNA, 803 bp, Homo sapiens
tggccgcttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatctttttttttttttttttgagacagagtttcactcttgttgtccagtctggagtgcaatggcacaatctcagctcacagcaacctctgcctcctgggttcaagcgattctcctgcctcagcctccaa

SEQ ID NO: 407815 - DNA, 872 bp, Homo sapiens
tggccgcttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcaggggtatgtttgagtgccacggtgtgcccagactctgctaggcaccagagagacaagatacgagtgacgtggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatcccagcactgtagaaggcagaggccggcagatcacttgagcccaggagttggagaccagactggggaacatggcaagaccccatctctacaaaaaaattaaaaaatttggcctggtgtggtggctcatgcct

SEQ ID NO: 407816 - DNA, 974 bp, Homo sapiens
ttactggatttctttttctcctgattttcggcctcagctcctagagtggcctcagctaggtaaccaacgggagtcgacttatctatgccaggcctgcagtttcacatctgtgacgggatgggacaaatgacaccgtggtattcgatgacagctcccaggtatttcaaggttggcccttactcattcagggggtatgtttgagtgccacggtgtgcccagactctgctaggcaccagagagacaagatacgagtgacgtggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatcccagcactgtagaaggcagaggccggcagatcacttgagcccaggagttggagaccagactggggaacatggcaagaccccatctctacaaaaaaattaaaaaatttggcctggtgtggtggctcatgcctgtgatcctagcactttgggagttaaaatacaacacttcccagctgcccttatagttaaggtctggccagtgaaatgtatgtggaaatgttacatgacacttctagaaggattcttaaaagacaaatacaccctttcttcccccttcctatttcctggaatgtgggtgtgatggctggagccctggcagccatactgccacgtgtacagacgagtgccgtcctttagggatgacaggagcctggttccctgatgatggcagagccagatatcagcacaaacttatttaaatgggagagagaaggggagaaccaatctcaacttctaccttgtgtaagctgctggttttgggggttttctatgacagataccaaaataaaccctaactgaacatatactcc

SEQ ID NO: 407817 - DNA, 1271 bp, Homo sapiens
tggccgcttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcaggggtatgtttgagtgccacggtgtgcccagactctgctaggcaccagagagacaagatacgagtgacgtggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatcccagcactgtagaaggcagaggccggcagatcacttgagcccaggagttggagaccagactggggaacatggcaagaccccatctctacaaaaaaattaaaaaatttggcctggtgtggtggctcatgcctgtgatcctagcactttgggagttaaaatacaacacttcccagctgcccttatagttaaggtctggccagtgaaatgtatgtggaaatgttacatgacacttctagaaggattcttaaaagacaaatacaccctttcttcccccttcctatttcctggaatgtgggtgtgatggctggagccctggcagccatactgccacgtgtacagacgagtgccgtcctttagggatgacaggagcctggttccctgatgatggcagagccagatatcagcacaaacttatttaaatgggagagagaaggggagaaccaatctcaacttctaccttgtgtaagctgctggttttgggggttttctatgacagataccaaaataaaccctaactgaacatatactcc

SEQ ID NO: 407818 - DNA, 900 bp, Homo sapiens
ctgaggcatgagaatcacttaaccactggaggtggaggttgcaatgagccgagatcgcaccactgtactccagcctggcctacagaatgaaactttgtctcaaaaaaaaaaagtaaaggcagtatccttttccccgtggggttgtgtgaggggctgtgtgtcccgggctttccttacatctgtgcctcagtccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatctttttttttttttttttgagacagagtttcactcttgttgtccagtactggggaacatggcaagaccccatctctacaaaaaaattaaaaaatttggcctggtgtggtggctcatgcctgtgatcctagcactttgggagttaaaatacaacacttcccagctgcccttatagttaaggtctggccagtgaaatgtatgtggaaatgttacatgacacttctagaaggattcttaaaagacaaatacaccctttcttcccccttcctatttcctggaatgtgggtgtgatggctggagccctggcagccatactgccacgtgtacagacgagtgccgtcctttagggatgacaggagcctggttccctgatgatggcagagccagatatcagcacaaacttatttaaatgggagagagaaggggagaaccaatctcaacttctaccttgtgtaagctgctggttttgggggttttctatgacagataccaaaataaaccctaactgaacatatactcc

SEQ ID NO: 407819 - DNA, 546 bp, Homo sapiens
tggccgcttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgaggtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatctttttttttttttttttgagacagagtttcactcttgttgtccagtactggggaacatggcaagaccccatctctacaaaaaaattaaaaaatttggcctggtgtggtggctcatgcct

SEQ ID NO: 407820 - DNA, 1306 bp, Homo sapiens
tggccgcttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatttttttttttttgagacggagtctcactctgtcgcccaggctggagtgcagtggtgcgatctcagctcactgcaagctccgcctcctcccgggttcacgccattctcctgcctcagcctcctgagtagctgggactacaggcacctgccaccatgcgcagctaattttttgtatttttagtagagacggggtttcaccatgttagacaggatggtctccatctcctgagttgtgatcctagcactttgggagttaaaatacaacacttcccagctgcccttatagttaaggtctggccagtgaaatgtatgtggaaatgttacatgacacttctagaaggattcttaaaagacaaatacaccctttcttcccccttcctatttcctggaatgtgggtgtgatggctggagccctggcagccatactgccacgtgtacagacgagtgccgtcctttagggatgacaggagcctggttccctgatgatggcagagccagatatcagcacaaacttatttaaatgggagagagaaggggagaaccaatctcaacttctaccttgtgtaagctgctggttttgggggttttctatgacagataccaaaataaaccctaactgaacatatactcc

SEQ ID NO: 407821 - DNA, 703 bp, Homo sapiens
tggccgcttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcagtatcctttttggggagccattttaacccttgtgcactgtaggtagggacataaaatggtgcatagcaggaccctgtaaaaattagccgggtgtggtggcgtgcatctgttgtcccagctacctgggaggctgaggtgggaggatcacttgaggccaggagtttgagaccagcctgggtatcagtgagaccccacgtctataataaatatagtaaagt

SEQ ID NO: 407822 - DNA, 399 bp, Homo sapiens
gatatatctaattggagttatggaagttgtataatattaatagtaagaactaagaagtggcaagattgaaagatagtgactgagatatttttgagaattgttatacaatacagtattttcaagaagctaaatgaaccatcaacagaaacataataaaaatgcagaagagagggagaaatttttgaacacagtcaaagagaaaagacagattatctacaaagaaattatagattgatgacttttccatagcagcagtgaagaaaaagagtgtattgtcttcagggcattgaggaaaataacctcaatactggaattctagaattctatgccaagtgaagctgcctttcaagaaaaagaacacaatgaagacagttcctgaaaaacaacaaaaacagaatt

SEQ ID NO: 407823 - DNA, 253 bp, Homo sapiens
agtagagacggggtttcaccgtgttagccaggatggtctccatctcctgacctcgtgatccacccaactcggcctcccaaagtgctgggattacaggcgtgagccactgcgcccagccgccagtcacatcttacatggatggcagcaggaaaagagagagcttgtgcagagaaactcccgtttttaaaaccatcagatctcatgagacccattcactatcccaagaacagcacaggaaagacccacccccatt

SEQ ID NO: 407824 - DNA, 188 bp, Homo sapiens
agaatttattctaaatgaggagatttttagctactcttaacacaaaaaaacaacaataaaagtaactatgtaagatgttggagacgttaatattcttcactatatgacctttttctctctatatgtatctcataacatcatgttgtataccttaaatatacataaaaattatttataaaatacttttt

SEQ ID NO: 407825 - DNA, 502 bp, Homo sapiens
ctttttcccaatatggacacctttttgtacttttttattctggtaacaatatgcagtttctgaggattctgtggatctccgtcatatttttcatgatctgcaagtgaaggctgaaacgctttatatggaattcttgacctggtaaatttgtgatgaatccaatctatgtaaacgagagacttcacaccttttgtcccagtctgtagttcattttgcctcttgagctactgacagcaaagtccctgccataagtgtggtggctgttctctttagagagagcgcctgctaaatattcagcatgaaccttcccaccagcagaagctgaggactcactgcttccattattacttacagatcacctttttgtatctgaaaaattttaccttaagtaattctctcttcctttcttccttttatttccctgaatggagtagggattagagaatggctagaaggggcagaggcttggagcttaataccttatggtgttttagcccattag

SEQ ID NO: 407826 - DNA, 287 bp, Homo sapiens
taaattcgcggccgcgtcgagcaaggtctcactatgttgcccaggctagtcttgaactcctgagctcaagcaatcctgtcgcctcgacttcccagtgttgggattacaggtgtgagccaccgtacttagcagatgttgtggccttgagtctcaagatgcagaatttcttcttccttaggggatctctgccttccactgattggataaggtctactcataattatagaggccgtctgttgtgctcaaagtctactgattaaacatgttaatcacagcaaaaaaaaaaa

SEQ ID NO: 407827 - DNA, 320 bp, Homo sapiens
ctaattttagtatatgtacccaaggtgagcactaatttaaaaaaaaaatagaggcaaggtctcactatgttgcccaggctagtcttgaactcctgagctcaagcaatcctgtcgcctcgacttcccagtgttgggattacaggtgtgagccaccgtacttagcagatgttgtggccttgagtctcaagatgcagaatttcttcttccttaggggatctctgccttccactgattggataaggtctactcataattatagaggccgtctgttgtgctcaaagtctactgattaaacatgttaatcacagcaaaaaaaaaaa

SEQ ID NO: 407828 - DNA, 415 bp, Homo sapiens
acctagctaatttttgtatttttagtagagatggggtttcaccttgttggtcgggctggtctcaaactcctgacctcaggttatccaaccgcctccagctacttgggaggctgaggtgtgaggattgcttgatctcgggagatcaagactgcagtgagccatgatcacctcactgccctccagcctgggtgacagagcaagaccctgtctcaaaataataaaataaaccagacaaaagatagggagaaggtctgtcctcctttccttcaagtccttgctcagatgtcagatgtcacctttttattcaggcttactctgattatcgtgtttaaaatggtaacccatgctcccttagacattcctgattctctttgctttgtttttttccataacacgtatcacttctcacatgcta

SEQ ID NO: 407829 - DNA, 317 bp, Homo sapiens
acaccatgcccggcctgggctcccaagtttttactttgctttcacgttccctggagtcttcagagggagcatggctctgttgacaccgtgatttctgacttttggcctccagaactgcgggacaatacatgtctgttgtttaaagccacccagtttgtgataattacagcagccctaggaagcaatatacttagtatggaaaaacaatgtgaaatttctcattagtaattttttatgtgaattaaatgattgatttgataatattcatttgggttaatacaaatatattggattaaataaaatatagtattaaaatg

SEQ ID NO: 407830 - DNA, 568 bp, Homo sapiens
catgtatacacacacacacacacacacacacacacacacatgcacatgtgtcagggatggctctcagagaaaccgtatttgatcagagagctaaaggaagtgaggttgtgagccacagggttatcttgaagaagagcattccaaggacaggggaaacttcctcaaagaccagtaagccagagtgttcttggtgcactcaagggacagggcagaggccagtgtggctgggtagatgggagagagctaggaagagaaaaatcacaggtgatgggattaacaggaaattagggactagatcatgtgaggcctgtatcttaatctaagtgagaagaaaagtcacaggagaacttgagtagaagagcaatatggcataaaaagtaacctttagacaatgtgatatgatgattaggagcacaaatactataggatttttgaagcatttttaaatagataacaataggacttgcccgataaaagaaatgctttaagtcacattttatagatatttgatggctttgcttttaaacgaagtcagtgatatttagtcaccttttaaataaaaaaaaaa

SEQ ID NO: 407831 - DNA, 1013 bp, Homo sapiens
aaggcaacccgtagctggtcctggagtaaagaaaatatgtctcataaaaccgcccaagaagttttctcaagataagaatttgtttcccttgactgaaacactaagaatatcttttttctgctttggggtactttcaaggggtcagcatacccaactcaaggaggtgcaagaaacaaacttaccacttaaatggtaatgctaagcggtcatgttctcaagcagagaaactctttcctaagtatctggaatctaaacatctctgttaaccctaaaaatcactatatgcataatccttactcactgtctaaacacagagcaaattcacttagaaacaacacctacatgaagggaacagttttataagaacacaggatcaccttacctgataagaagaattgctgttgtggttatatgttaagtagaactgtgttactacaaggaaaagtaaaggcacttgtacaaattcccggaatgctttcttgtgttttatatgtatgaaagaagaaaagaagcagaaaagggctaatggggaaatttttttaaattccagagatcctgaccaggcatcgaatcaagctgctatggatacacgaagcaggtttcaactgcccacagctgagttaataatcagtgtcttaatcaaagacctcggcttccaagcctgggatgaaccattttcccttggtagcgtgctgttaccagagcaactcctagaggagggacaacagctaaaacctaggctgaaactcaacaaatgagcttatctgcaagctttatcatcagactctcccccaaggcattacctttcacctaagccctgtgaccttaactgacagccctccctccaccccatgcaatgcagagctctcctggctacagaggaaaggtagaaaacctctcaaaagtcaggcttcccctgaccttgcaacctggatcactggtgggtaaaagaatacaaatgactaagatgggccaagagtccaggagtctagattgctacccccacccatcca

SEQ ID NO: 407832 - DNA, 421 bp, Homo sapiens
acatttggctgctcagaatttctaaacccaagggtagagcatgatctgggcatctccaaataggaaagttcttatatgagtactcctaatgtgtccacccaccaaatctattttattgctgatgcacgttttgccctggcctgcaccttgctgcctaggcctcttgagctcctggtcccgtagtctcacacatccagctatgtgtccgtcacaccccaggctcttgtccttgactatcttcagacacctctcagtttattcttcacagtttgctcttactcctctctttccttgttgctttgttttctggtcctgggtcacatcttcagtagctgcttttggtcactttggtgtgctgatccttgtattgacctttgggtcatggttttccacttaacttacaactcttctctgatttttt

SEQ ID NO: 407833 - DNA, 836 bp, Homo sapiens
aagctaatgggaattaatagatacaaagcattttagaactcctcctggtacaaagtaagtactttgtgggtattagctgctgctgttgatactaatattctgcaattcattttttttaaatggtaagtaagtgccactaaatcaatttcaggtcttcagtgagttccaaaacaaaatttgaaaaacaccatttagatggtggaaatcctctcggcttgcgagggtgggatgaggaacctggaggcattggagaggcaggtggcctctcataaatgactcgatatggcttgactctgctcctaaagatagtgggtagccattcaagagaatagcttgataaagtttacagtgtttagaaaattaaaagattcctctaaccacagtgtgtagagtgaactgaagggctagaccagagtgatgtcaggaactgtgaggcagcttttgtaaaaattgtggccagtgatggaggtagccgtagggacagagacatatagatgtatttctcaggtagactctaggggacttgcttatttgatttgatgttaaaaaaaaaaaaaaaaaaaagaaaggagaaagaacaataagaaagaattgccacagttttagcctggtcagctgggtggatagtcacacaccggctagtaaatactggaagaggatcctatttggaggacatgtgacatgttgcatctcataagcctgtgatatgtctacctggagggaactggagggtggaagagggggaagggctggcactgtagagatttggaaatcaaagacatgtcaggtggtgcttgcaaccatggcagtgtgagtgaacagatggtctgggaagt

SEQ ID NO: 407834 - DNA, 335 bp, Homo sapiens
gctactcaaaatatgattcctatactaccgctccaatcctatttaactgactctctgtttaacacaatccactggtgattcagatgaatgataaagtttggataccttcagggaacctgtcctgacctctcagaccagatcacatacactgtcttctccattagactacaaattcatgagggaagggacatctctgtctcattcttaataggctgtgaacactaagtatggtacctgacaaagtgtaaaggctgaataaatacttgcgtgggtgaatggacaaacctagattacatgaggttaaatcaggcagactgtggtggatgtggttgcta

SEQ ID NO: 407835 - DNA, 423 bp, Homo sapiens
cactgtaactgaatttgcatttcagtaccattccaatagggcacagagttgagaattgagtgcaaagatcatgaggaaggtcagggtattaccataatggtctaggcagagaaagtatacatctttaatagggcaagacaatggagttagacaccttcattcattcaacaaatctttatgtgggggcatatggcatgcccctaggctgctggggatgcagagtgcctgtctgaggattcagccactgaatggttgctagatggtcacgagtatgaggcgctttaaaaatttaatctcatgtgggaattacatgggggagattccaaggaaccacttgcgctggtgcgtccgcggccgtcgcgaggcgtccgtccttccccgagggcgagcgccgggcaggcagggactcgccacccgcagccc

SEQ ID NO: 407836 - DNA, 411 bp, Homo sapiens
aaaaaatatttattttatttttgtagagatgcgggtctcacaatgttgccaaggctaggttggtttttggcctcaagttatcctcctgccttggccttccaaagtgctgagattacaggtgtgagccactgtgcttctttgtctagtaagttttgatttgctactggatattgtaaatgtgatgatgttgggctctgggctttgtggtcttttgtaaagaatattgggttttggccaggtaccttggctcatgcctgtaactccagcactttgggaggccgaggcggacaggtcgcttgagcccacgaattcgagcctagcctaggtaacatggcaaaactctgtctctacaaagagtacaaaattgtcattgcatggtggcagaatagcttttactctagggaacttcac

SEQ ID NO: 407837 - DNA, 398 bp, Homo sapiens
aacaataataataatacagaacaattattaaaatatactgtaataaaagttatgtgaatgtggtctctctttgcttcccttctctctctcaaaatatcttaatattcttttactgcagttgacgcaagtaactgaaacgaggaaagcaaaacgacgattaaggagggagtgctggactcacaaatccctagagacagggcccatgccacaccatacaggggacacatggggaagcgccagggtcagtgaaggggagagggatgtggggaaacactgccaagagcctccatggtgttttccacaggaaggaaggtgcagcaggatgagcaggattaggataagtagctagtctgaatcattacagacggcgctaggaggtaggggctgtccctaattgt

SEQ ID NO: 407838 - DNA, 437 bp, Homo sapiens
ggtgctttaaaatctatccccaatgaaaggccgtgcaactggttccttgcagaactgctcttacccgactgtgctgttgtgggatcccagcagcctttactggggaccagaataaaaaacagcccatgaaactgcttcctggaaaagaatggtttagaagaacacattggtggaattccttcctggtatcagtactgaaaaaagtcaatgccacttctgaacaatgagattattccttacaggcagggcaagctatgtatctaatcatatatccttctctgaattggcagctctcaggcagagccaaatatccagtctacttctaccacatactgtgtgtctaagctcactagacctgtttgttctatttccctttcaccttactctccttacttgttcatttatcttacctgtttataagtctcattaaatccttt

SEQ ID NO: 407839 - DNA, 454 bp, Homo sapiens
acaggatttaaagctgtacagtcaaactccagtgcccacgcacttaatctcaacacctctttgctatctccctagcagtttatgaatgagaaaaccgagcccaggatgtctgactctctcctgaggtcacacatcaaggtgctgccacagccagatctagaacccaggttaactcttgtctcatctagggccttgtcttcttgaagaacatacttactgtggaaatacaggtgaaaattccgcatcaaacagagataccaaataacagctctaaatagacagtgatgcatttgctctctccttcttgttagtgtagtttaatttcctgagaagctttacacatacccctgagcttttctgtcacagctaattgtgcaacttccaagtagttgtcctgcctatgtttgttacttgggctcattaacataccctttaccgtagatgacactctcat

SEQ ID NO: 407840 - DNA, 335 bp, Homo sapiens
ggtcagagaagttcggaatttcttttgtgatctctcaatttgtgtggtagtaaagtgctcacagagtcacaacttagaaaacttgatttcttttctccattttattgtgagtttgaatgaccaacttaagtatttaatttctattatttataatgaagcacttttcaattcaggctgaatctcagaaaaaatgaatataaaaatgtaaatataattagaacaattgaaacatttttattgtgatagaatatatataacatgtaatgtaccattttaaccatctttaagtgtacagttcaatgacattaaatacattcttattgtggtgcaggtgc

SEQ ID NO: 407841 - DNA, 426 bp, Homo sapiens
gtagcaagagctagctgacacaattgcatatccaatatttgaattcaggtcctgaccttacctaagaccctataactgaaaggggagctggaaagtggtcctagtccatgttcctcaggagaaagaggaaaatagatttggtgaggttttagcccagtctctgccagcatgtgcccccctggttttacacccattcatcccagcttgagaaccacagtaatggtgatggatttaatgcatttaagcaaaagggtgcattgaatgcatttaagcaaagggatgttatggttatatttggctatttgaaatattactctggaggaagagtgaaaaatggattggctgaggtgagactgagaacaggaggcagtttgttttggcaatggactataatgaggggcagtaagattaaagaggaaaaaaaaa

SEQ ID NO: 407842 - DNA, 594 bp, Homo sapiens
atactcaggtgtgctgctctggagtctgcattcttaacaattatggtaagcagatcttgataaaataatgaaagctgtgaaaactacaaagtactatctaattctttcatcaagccttacctggaaactggccagttttttaattcaaagccctagtctttgcctacagaagtgttagggtccttaaggggccttaggctgctgtcctgttacccctagtctaacccctggcttgccttggtcattgctcccccactcagtcttgccagctcagggtaggggcacccaagtcctagcagctccctctcccagctcttgcacccaacaccctctgggttaagtcactgtccactgaaaaccctttcttctcttccttagtcttccctggctgtccagaagaacaagcctatcagcaagaaggaaatgattcagaggtccaaacggtaagaccaagaaaacaagagtttgtgtacaagtgttaaccaggccaccaagtggtcaggagctctggcttgcacccagaataaaggcattatgctcaaatttaaacattatgagaaagttgtgagagtcatttctcacttatggcactga

SEQ ID NO: 407843 - DNA, 1075 bp, Homo sapiens
tttcttttaactgtggattgattttgagattttgacttagattttagatagcttttctcagaagaaataaacgcaaaaacccgatattgttgtaacatcagtttcctgtgtcctctagaatcatttaaaacctggttggatcttccataatccagtggaattggatatgagatgtagctggagaagtttgttttgctacatatcagaatctccaattagtttcatttagaaaggaatatagccttataattttatgctgggttactgtggaaccaaatatcatagaaggatgtgtgatatttttatgtttttcaagaaggtagtatagatttaaaaggtgggatacatattacctgtcctaatgataggactagatttttttttttttttttttttggggagacagaatctcgctctgtcgcccaagctggagtgcagcagcgtgatctcggctcactgcaacttatgcctcccagtgattctcctgcctcagcctcccaagtagctgggactaccggcatgtgccaccacacccagctaatttttttgtatttttagaagagatggggtgtcaccatgttggtcagactggtcttgaactcctgacctcaaatgatccgtccgccttggcctcccaaagtgctgagattacaggcgtgagccaccatgcctggctagaactagactcttaatctcttcatcctaatgcatggcgtgtgttgatgttcacttaatgtctgtcaactgggtgtagttacaccagtagcggagaggctaatctttgaaagcctgaagtgttgtcttcatctttgcagggtttttagttgtgggtgcatatgggaatgattgtaagaccaacaaatgttttctgattccatatgggcttcttacatttttcaccttggaatctgggaacaattgaaacctaccatatgccttgaacagtagcagtaaagagccagtttctttaaactagacattatggtgctgcagctcatctcaaaactgatagcaggctactctggacacactacatatagagtagccctgctctgcaaggagcagtaataaatta

SEQ ID NO: 407844 - DNA, 250 bp, Homo sapiens
ggtgagaactaaccagtgtttgtgtattcttgatcttcaaaaattattcacgttttcaaatttttgcattttctgagaagtttttgtgagaaatattcacagacattttcaactatatgaagggatatgattttattaaccagtgaagaaggttaaggcaaaaataaatacttatttaaaatacaggcatctactgtatatctccggtgaccttaaagtacatttctattataataaaggtgaaaaatat

SEQ ID NO: 407845 - DNA, 627 bp, Homo sapiens
ttgaggaccccgtgcagaatacactcaaaaggcactcctccatgaagttttccaagattctctagaccatcaataccctttcccatcttggaattcctgaagttttctttgtatctgtcttctggccatctcacagtctctcatattgtagttaatgcctataaacctcacctgctagagttaagctaggcaatactatattatttatctttctttttctttttctttgagacggagttttgctgttgttgcccaggctggagtgcaagggcacgaatctcagctcactgcaatctccacctcctggcctcaagtgattctcctgcctcagcctcccaagtagctgggattacaggcatgcaccaccatgtccagctaatttttttttgtatttttagtagagacagggtttcatcatgttggtcaggctggtcttgaactcttgacctcaggtgatccacctgccctggcctcccaaagtgttgggattacaggcgtgagccaccacgctcggctttaattatatttctaagcaaagagcatcctactaatctttggggcaccacagtgcttggcaccattactagcatatatggcagatactcaataaatatttgtcatatgcaa

SEQ ID NO: 407846 - DNA, 254 bp, Homo sapiens
ctgctttatattcgctggcagctgcttagattgtgcccaccagattaagggtgggtctgccttccccagcccactgactccaatgttaatctcctttggcaacaccctcacagacacacccaggatcaatactttgcatccttcaatccagtcatgttcacactcattattaaccataacatttatctttctaaaatagaacaggaaaatatccatgattataaaaagagatgcctcattaaatgctattagaa

SEQ ID NO: 407847 - DNA, 1029 bp, Homo sapiens
  misc_feature (1)..(1): n is a, c, g, or t
  misc_feature (7)..(8): n is a, c, g, or t
  misc_feature (10)..(10): n is a, c, g, or t
  misc_feature (613)..(613): n is a, c, g, or t
nagttgnnangggaaagaaaatgatacctagagaagagcatcaaagtcagatctttttgtagtttgcttttttactttgtttttacttaacccatttatgcctaaggttgcaattttttgaatttttgcaatcagaccttggcgatgaccttgaacaacagggtataagtaactcccacatgcttagtgttccagtaatggaacacagaagaaacagcatacagcatttaaatgaagagagagaagatttttaaaaactaggagttgggcagcataattattaatataattattaataggtatcagtcacatgtccttttcaagtaccagagaccatgccaagcattttacagtcagaagctaatccctgtaataccttacagatataatagatatcgtcatctgtcaaatggtgatctgttttataaatgagggaactgaggcatgcaagagggggtagaatctagaaccctgataggagtagccgcagtaactcctccatgtttaaaggagggcagggtgccaggatgggtgtgggtgcaaatgtatttagttgaggcgcgagcatggcattaaagaacatgggcttgggaaaccgtaatggcagatttcngtttatagcccagctctgttagctttataaatcccagaaagtgacagtttctttcagcttgtttcctcttctttaaatggggataataataggattacaggatattagcatgatcattgtgattaatataagtaaacagtgcctgaacactgttggtgggaatatgaattagtacagctattatggaagttcctcaaaaaactaaaaatagaactaccatgtgatccagcaatcccactagtaggtatatatccaaaggaaaggaaatcagtatgtcaaagagatacctgtactccagtgtttattgctgcactattcataatagccagaatatggaatcaccctaagtgtccactaatagatgaatggataaagaaaatgtggtatatatacacaatggaatactattcagccat

SEQ ID NO: 407848 - DNA, 398 bp, Homo sapiens
gacctttgatatcatttggttcagcaaccttaatctgggtattaatttcctcctggatgcacatttttctaaagagaggatccacggctagcaacctattcttgaagggacgcttatccctccataggttaaaaatcacagttctaatctatccctttcttttacaagcaaggctgtaatctcaagagttaaacggtttatctttagtcccacagaaaaccagtcggtgttgaaactcaggcccctgactcctcatcttaatctcttacgaaggcctctcaccacgaaatgaataacactacaaaagtaggttcaaatacattacactcatgcttgacatgttcggttacaaaattattcctcctttctgggctagcctctgctgtctgagttctctt

SEQ ID NO: 407849 - DNA, 1011 bp, Homo sapiens
ccagggtccacagggagacccgttgtccctgctcccccaccaatttctcccaagagaaaggaggtctcagatgaggacccttttgcaaattgttgctctggaggctgaaaaatcaagctcgagctgcctgctggtcctgatttccttcctggccgttagtccctgcctttttcctctttgtcggttttcaaacgcaactgcccgcgccaccgggagctgcccctgacttcctccttccctcctggccccagctctcctgctcttgttcctgcccctgcctccctccctaatacactcaactgcttaaatgtcatttgtgaaacaacagaaggacgtgctgtttttgcagcatcttggggaacaatttttttgattcatttggtgttaagaacactcataagaaatgtattcagtgaccctcgccagcctcagtcactggtgtggttcccatttggtggttggtgagcaaaacattttccccccagaaatgtccactcttctagcactttcagcctttctccgtaggttcctttgtcttcaggtccttgggtacttgaagccctgcagttgctagttcattttccagctgggagagcgatcctgatccagctccttctcaggcctttgaaccaagttctttggcaactggccagggagggaatatggccatgtcaggcgtgcttttccggcccatgagataaaaggaatggctggaaacactattccttccgtgactcacagggccaacctggcatgtgcaaggaacccgtcagactgggtggggacctcccgtccaaatttacctgcgcagacacagcacctcttggaggagctaggaagtgggagttcccttagcacgtgatccatatcttccctccaggccctaccgtgcctgtcttgtagcatgacgatgtatattctcaccttagtagtccccttagcctgtaaagctctttagggcaggatctacatctgcgtaaccttcagggcccccagtgctgagaactgtgc

SEQ ID NO: 407850 - DNA, 426 bp, Homo sapiens
caaggtaactgggattttaggttaaaaaatgtacattatatatggatagggaagataagagaatgtatggcaaagacattttaaaagttatttcttctagttttcattgagataccatttatttttggctttgtaatttcttaaaatatgagcagatttccaacagcagatgttacctttataattccttcgaagagaaacctccttgtacaatcaagtataaagaaatttccagctagggaaaatagatgttgatatatggaaacatgcaatttatgtaagttggtgcagaagactttgtataaaactatgcccagtataagtcaagttataattaaggtgaaataaatgtgcacatatatgtatagcaatattatatattatatatgccatatttaaactataataaatggagcaataagaaac

SEQ ID NO: 407851 - DNA, 336 bp, Homo sapiens
aactacttttttcatgtaattatgaaaatttgaggcttttttttgagacggagttttgctcttgtcgcccaggccggagtgcagtggcacagtcccggctcactgcaacctccgcctcccaggttcaagtaattcttctgcctcagcctcatgagtagctgggactataggcgtgcgctaccacgcccaactaatttttgtagaaaaattacggctttttaaagatctactaattttaaccaatttgccattagtccattagttttttctttaaacttgcctacactactaaaaccagttctattgcctttatcagattctttgttctgtgagtta

SEQ ID NO: 407852 - DNA, 583 bp, Homo sapiens
attaaaagggcatctttcagtttttagaagtgggagttaatgggcaagctgggtccaaatgttctaggatggacccacgtgatgccgtgcagagtggtttggtcaacaggccaaagttaatgatccacagctggaagtacccaacaaggcccaaaaaggaagggtccttcttggtgtggggaaggggcacatcctgtattagctccttccatcgggctggcatggctcaagaattaggggttagggtgagtccaaggttagtgacttgggtttgggctacttgagcctttgtaggtaaaacctgatatccctggccatagaggaaatttagaagttgggtgatgtgttgatggatagatcaaaggagggactacacataaggaggtcattgatgtattgaaggaggctgctaggagcaaggggaagctcgattagttccttggtgagagcctgcccaaataggagggggctatcccggaacccctgtgggagtacagtctgttagttaggtagatgtgtgagtatctgggtctgaccaggtgaaagcaaaaagactttgggaagccagatccaagggaatagt

SEQ ID NO: 407853 - DNA, 414 bp, Homo sapiens
actcctaagtctctttgcaggaaggggaggaggggacattaaaatgtcatctttttgaccaagctgttaaaggtttccaaggtattcatctgcaagttaacatgcaattgaaggaaaatattttaaaggagaaaagatttcacaggtcggcgtatgtcttaaaaatgtaaaacaatcttttctaaagcatagagatgtaatcagccattctctttgactctacataagagtttcaaattgcattagatgttgattacttgtatttcagagtgtatagaaaccccagcaccatttcattttctccctctttgttatcagaatgtagtgtgtcctggtgtccagatttttacgggtttatcaagtaagagaggaatgtaaatggaatatttgtctggttttggtgaatacaattgt

SEQ ID NO: 407854 - DNA, 1011 bp, Homo sapiens
aaccgcaaagcctgccgggagcttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacaaaaaaacaaacacaaacaaaaaaaaaacaaaaccttgtgtgtgggcgccgcacccggggacccccgaaaaaaacgctctttcaaaaaccacttgcggttgtgggcgcaccgcggggacccaagagggtaacaggaaacccggggccaagagaggggttgcccccaggagagaaaaaacgcggggagccgaagtagacacaagccggggcggcggggaggtttccctcacccccaaatattaaaaaaaaagagcgcccgggggggaggagactaccagcagggcggggttcgttagagaaacaaaaacctccacagaaaaggggggagggtctccgagagaagggaccaaaaaccgagggggggggcactctacatcacaacgagggggagaggcccacaaagcagaaagcgccaccgaaaagaccaaataataacgccg

SEQ ID NO: 407855 - DNA, 1612 bp, Homo sapiens
aaccgcaaagcctgccgggagcttggtgcgctatggcgacacccagcctgcggggtcgtctggcgcggtttgggaacccgcggaagcctgtgctgaagcccaataaacctctcattctagctaaccgcgtcggggagcggcgccgggagaagggcggtgagcagtcggagtcaggacggccccggagcggaagccggagcatgagcaggggcgggtgggtaggagggcaggaaggtgggtcttcttgtgactgaaggtcccccggatctgcccctccagaggcgacttgcatcacggagatgtcggtgatgatggcttgctggaagcagaatgaattccgcgacgatgcgtgcagaaaagagatccagggcttcctcgattgtgccgcgagggctcaggtgaccgatggctcctggggtgctttctcaggaaaagaatgggggagatagaagtaatgattctccctgccttttgctaggaaaggccctttcattcatttgggaggtatattattcacgccaaagtgggaaaggttacagttttgaaggctgtgtgatcttgacggatttattcattgctctgaactttcgagttactgtacgtaaaatgaggctaaccaataccaccttaaagaatgttgtgagtgtcagatgaagtaatgaatgggaaaatcattttgaaaaatgtaaattgctgctcaagtagacattattgtgtgaaatagaactaaagagactaaaactaaataatgacaatagtttggtttcctgtctaggcttaattgctagctgagatagtagcttctgaacatagtctcatttgtaggtcccaacgcccttttgttgaaaagaggctgacatagatctctccaggctggttaacatcttcatgtgctttagggcattgtgagaactatgggcctacatcaggacaaacttgattgattgattggttttttgggtcagatcttaaaagtctggactagacaaactgtagagctgtcattcttgtatttgttttgtgttttcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacagaacttggccttttgttgtgaattaggtactctcttcattcttgagcctcccctagaccctggaaattctttccttcctgatttgccctaggagcaggacaaataccgttgtattgtctttccctgcatttgaagtcttttacaccatttagtgcccttgcttttggatgcaataaggaagttgaagttgccttcgtctgtaaatacttagtgattgcctattttgtgcgtagtccctgcaaggtgctctctgaataataaagttaacaaactggtgacctagag

SEQ ID NO: 407856 - DNA, 606 bp, Homo sapiens
aaccgcaaagcctgccgggagcttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaaccgcctgtgggagttaaaaaactataaaaaaaaaaa

SEQ ID NO: 407857 - DNA, 857 bp, Homo sapiens
aaccgcaaagcctgccgggagcttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacagaacttggccttttgttgtgaattaggtactctcttcattcttgagcctcccctagaccctggaaattctttccttcctgatttgccctaggagcaggacaaataccgttgtattgtctttccctgcatttgaagtcttttacaccatttagtgcccttgcttttggatgcaataaggaagttgaagttgccttcgtctgtaaatacttagtgattgcctattttgtgcgtagtccctgcaaggtgctctctgaataataaagttaacaaactggtgacctagag

SEQ ID NO: 407858 - DNA, 1489 bp, Homo sapiens
aaccgcaaagcctgccgggagcttggtgcgctatggcgacacccagcctgcggggtcgtctggcgcggtttgggaacccgcggaagcctgtgctgaagcccaataaacctctcattctagctaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggtgaccgatggctcctggggtgctttctcaggaaaagaatgggggagatagaagtaatgattctccctgccttttgctaggaaaggccctttcattcatttgggaggtatattattcacgccaaagtgggaaaggttacagttttgaaggctgtgtgatcttgacggatttattcattgctctgaactttcgagttactgtacgtaaaatgaggctaaccaataccaccttaaagaatgttgtgagtgtcagatgaagtaatgaatgggaaaatcattttgaaaaatgtaaattgctgctcaagtagacattattgtgtgaaatagaactaaagagactaaaactaaataatgacaatagtttggtttcctgtctaggcttaattgctagctgagatagtagcttctgaacatagtctcatttgtaggtcccaacgcccttttgttgaaaagaggctgacatagatctctccaggctggttaacatcttcatgtgctttagggcattgtgagaactatgggcctacatcaggacaaacttgattgattgattggttttttgggtcagatcttaaaagtctggactagacaaactgtagagctgtcattcttgtatttgttttgtgttttcaggaagcccgaaagatgagatcaatacaggaaaccctgggagagtctgggagtttacttccaaataaattgaataagttgttacagaggtttcctaacaaaccttacctcagctgaaaatggacaagtattttcaatgactgaaatatagcttctgacaactatgcagaggcattttagagacattggcattgccatgccctctttggagggtagaagaggcaaaacacttttttcaccctttggaatcatagtatgggtagaagttatgatttatcttgaaataaaatcctctgaacagaacttggccttttgttgtgaattaggtactctcttcattcttgagcctcccctagaccctggaaattctttccttcctgatttgccctaggagcaggacaaataccgttgtattgtctttccctgcatttgaagtcttttacaccatttagtgcccttgcttttggatgcaataaggaagttgaagttgccttcgtctgtaaatacttagtgattgcctattttgtgcgtagtccctgcaaggtgctctctgaataataaagttaacaaactggtgacctagag

SEQ ID NO: 407859 - DNA, 1310 bp, Homo sapiens
taagatacaaaggaatgcaaaattaaaaaatgatgccaggaaagtaaaacccagacaccatttcgttatcctgatatctcacatagggctctaataaggcaatgtggtgttgaacaaaagctcatggttcatttaacttcctgatagtttcatattcagattgaaatctgccaataaaaacatattgaaaatattattagataagattacccccagaaaaaaggcaaaggaaagtaacagctccaaagaaaacattcgatgtgtttaaacggtgttgaggcgccccttgctggcatatgtgtgtattatccaactctatctgcatttcttgacctttttttggtaaatttggtggtgcaaattagttctatattttatatttttatatatgtctcttttttggtgttgcttgaaatggtgtaaaatgtgattcattctccagtttcttccatgcgtcttaatttgtcagagttttcctcagttcccttttctctgtgaacttttcatctttccctgcctggtcactctgtccttttactgaccttggctttactttttaaacaattggttctacgtcctgtgaggtttgggttttgtgggacttggtgacagccctcctgtgactgcctttggtgttctttgcctgtgacttccctcagtggcttccagcagaggccccaggccacaagctgactcctctctgagattccagaaggcgacaggccttgcgtaccttaaatcatcctctttctccattaactctcaagtcgacgatttaagatatgtcaattttctcaacttccatagagcatcagaatgtgaattcaagaatcttagaactaatttagaaagaaaatactgagatgtgagaaggagaatgcatgttcaaaggcacaaattgaaattaaaatattgtagttaggcgagcacaggacttttgattacaccgagcggactcaagtctttgtatccaaagtattctatttgtaaatcatatttaatttctagaaatctgaaatattgaaatagcttctaaagaggtccataggaaatgtatgtcagggtagaataaaaattacacattctttcttattcagcattgtttaaatcatcatgattgaaacttctgtaacttcagtacaccatgcagccttctatgtggtatggatttctaacattggagttctctgcccaaaattttctgagggactttccctccctacctcaatctgaaagtctgtgggatgggggagccaaggctctgaacagctctttcatccatcttatgtgcaaggataaaaatctctagg

SEQ ID NO: 407860 - DNA, 2725 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctagagatcagacttttttgattgtatagtttgcattaaaaagttgtacagggagggatgtaacctgtatcttcaggataatagggaaattaataaggaaaataataattactaaaatttgagttgaagtcagggaattatttctttggttttgagtctctttatacatccattagtagaacctgtctagtctgattgccacagtccttgaattgatggtaagggggagtcagttacagttagaaaaaaacctgggcaaaaactactagttaaatgatcatgaattttgagtatgtgttttaaaatgcttggagttattgcagaaaaatgatattctccattagaacatttgatgtgtgacttttgacataggataaggtgataagaaaattaagttgaaaaatagtgactcaagtacagcaaatcagatttttggctactgagattaaagaagcaaatatttaaaggattatcagcaattttcaaatacatatttttcactgcagtggttttgaagaatgttttaaggttatattta

SEQ ID NO: 407861 - DNA, 1836 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407862 - DNA, 2252 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407863 - DNA, 1782 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407864 - DNA, 1699 bp, Homo sapiens
  misc_feature (375)..(375): n is a, c, g, or t
agcatctcagggcaacggatgctactaaaatatccgatacttatctaatctcttaaacttccttgagatacttctagtttctctattttaatctatgaagagagtcgtcactccatcgccccccttaagattgttggtggcccttaagattgttgatggccaaccaacaatcttcagagagcaccattgaaatcctgagtgatgtgcgtctgatcaagactggacacaatgtgggacccagagaatccacgctgctaaacatgctctaaagatctccccctatctccttggggctggtcactccagcaggtgttcgacaagtggtatcatctacgaaccctgtacatgattgcatgttgcaagcaatcttcaggnatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407865 - DNA, 1788 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407866 - DNA, 1701 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407867 - DNA, 1591 bp, Homo sapiens
  misc_feature (375)..(375): n is a, c, g, or t
agcatctcagggcaacggatgctactaaaatatccgatacttatctaatctcttaaacttccttgagatacttctagtttctctattttaatctatgaagagagtcgtcactccatcgccccccttaagattgttggtggcccttaagattgttgatggccaaccaacaatcttcagagagcaccattgaaatcctgagtgatgtgcgtctgatcaagactggacacaatgtgggacccagagaatccacgctgctaaacatgctctaaagatctccccctatctccttggggctggtcactccagcaggtgttcgacaagtggtatcatctacgaaccctgtacatgattgcatgttgcaagcaatcttcaggnatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaagacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407868 - DNA, 916 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgttggaaggttctggctcgtttgggcgaacggtgctgcatcgaaggattggttcagactgggtttagaaccggtgagataatatggagaaagggttgagggtaacccagggaaaaaagcgggaaaatc

SEQ ID NO: 407869 - DNA, 1167 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagt

SEQ ID NO: 407870 - DNA, 2015 bp, Homo sapiens
agcggagctcttcagtagtttctgaacatctagacggtaggatgtagaatagggcaccagggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407871 - DNA, 2205 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaaaaaaaaaaaaaaacaaaaaaaaaaaacaaaaaaacaaacacaaaaaaaaaacaaaaaaaaaacccacaaacaacaacacccaacaacacccccaccagcccgccccacccctcagagggggcgcccaacatcacgacgccgcatcactcttcacagagaagaacgggtccccctcaacgaggctcagactcaatagacgaacacccgcgcgcgctcacataaagcatgcagttgataacacacgtcggccgtcagtctgcgggaaaaccccccgtcgcggcgtgcaatgagccaccccacccagcaacgcggctggagtaacatcggggtgtcgacacctctgtggaatgcgggatttataccgggcac

SEQ ID NO: 407872 - DNA, 1531 bp, Homo sapiens
  misc_feature (207)..(207): n is a, c, g, or t
atcttctgggagtcgaatgaaattctgagtgatttgtagtggattatgattgaaaacaaggcgggagccagcgaggctcagcgcagttgaacatgctctaaagatctccccctatctccttggggctggtcactccagcaggtgttcgacaagtggtatcatctacgaaccctgtacatgattgcatgttgcaagcaatcttcaggnatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407873 - DNA, 1961 bp, Homo sapiens
agcggagctcttcagtagtttctgaacatctagacggtaggatgtagaatagggcaccagggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407874 - DNA, 1728 bp, Homo sapiens
taagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaagacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaa

SEQ ID NO: 407875 - DNA, 1812 bp, Homo sapiens
gaattgtttttcttatatatgcagcaatgtaattttacattgatctgcggggtggtttaaattttatttttacaaggcagtttttcagtcaaattatatatttgatacaatacgctaggatagaccggccacacgtcaggcagccgggacaccggagtgtccccaggaggcctttggggctggggtggcccgtggcttgttccctgcgcctctgggaactggatgagtccttcggcgggactgtgacccgctggacagttaaaaggatttttcatgggcattttcctacacataaggcagttccattaggaggagctttagaagtcgacataatccagacagtggacaatcccagtggcccagacaagccatacgacattttcctgtgacctctctctgacccatctctcacgctcatgagaaaaggaatgtacaataaatagaaacagaaacttcctcagtgctcatgcgcctcacttgcagaacgtgagtatttcatttatgtttgaagcccttccccaaagtgaccgaggagttgcactctagctgccgtgccagcagtctcgtctgctgtgacgcttctcggtgcggatgcagtgcacctgtgactttgtcatgggggtgcccctgttacacacacacacgctgactcttttttatgaggaaaatcttcgactcaaaataattgcactgattttttgacaacttctttttacgatgtcccacttcgcatctgctgtacttgtttgagatgattgtaaatagatttgtggtaggagaagtgacatgaatgcaacacgtggctctgttgtggagacactgcctcgtattcagtattatgtgttagagttgtgtggacttaactctgttccgccctttagcttcgtgtctgttgaccatttatgaaggacaagttcgcctcattttctttttcttctgaagggaagttctagatcggttactaggagaacatggtctcttggtgcctgatgatttagtcctaagcagactcgttgcagtcttgtgaacactgttgtggtctgtttgattcctcgtcgcttaccgtggctctccaaagcatggtctttgagttccacccagcctgggacagtccagacgggaggcatctgctccgcctgctactaggacgcaagggcctccttgcatctctgtggtcagagtcatcttaaagccatgaggttactgtcgtgtcaaagctgtcatttgtgcccgttattttgctggagtagcagcgtgtgctgtagcccccgtgtgtcactctgtggtcaggctaccctgtgtcacacccagcaagaagtttttcagccccagaccagtctgtgtgtgtgtccgagtcacaccagtgccattacggtgccctcgcttatgcttctttcagtatgttttgccatgttattgtctaaagtgaatgtattggcttagccaaatcactacagaaggtggttcctaaataccttttagtttaaaaaaaaatgcagataaaggctacctctgaattctcaatagattcatcatgtttgctcttaagtgtagctgtccacactgaaaacagccaatatgttgcctgaataaactgaattgtgaacatctatctgttcagttctggcttgaaaatgtgtgtgccatactgtgacccacgggcagcccctcctcctctactgtgtcaggtggaccagggtcacctctgttctgcgcagctttgagattctaggattctacggccatgcctagctggattgcagagttaagtttatgattatgaaataaaaactaaataacaaaaaaaaaaaa

SEQ ID NO: 407876 - DNA, 621 bp, Homo sapiens
cggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaa

SEQ ID NO: 407877 - DNA, 469 bp, Homo sapiens
ctccccgtgatgcactggaatagggaaaggggatagtcagtactctccatcgaacttagaagaagatcccaaaccttctcagatataacaaggtcctaggagaagttggccctgcctacttctcccagtctacctcctctcaaacttcaacctctcatcactgccccagccattctgccctcctgttctttaatccccatgaggtcctttactcacacacattcttttctcagactgggaagtaaaaagaagtaggtccttgcagcagttgggactagagggtttgtagagttgcttggggtcaaaacagaggttaggggtgaagaggatttggaaggtgctgccactgctaagaggcccaggagtagcagcatacagggaaggtaaagaggtaaagattctggacctccaatcttctctgggccatgtgctccctcataactgtggtcctgggggtaaatgtgaggtt

SEQ ID NO: 407878 - DNA, 390 bp, Homo sapiens
cagagctcctgcctggataggttatttcctcctgaccacctgacaagggactggccccctgaggcttacactttgttgagacctgaaactgcagacagagcactaaacttagaagagactagggccccaactaagcttccccatggatagatacatagtcatcatagaaggcaatcaatcatagaatgtgacacctggaagggaccctaaagccaaatccttcattctacatttattgagactgaggcccagaaaggttaaattacttgacaatgtctaagagctaattactacagaaatcttcctctggggcactttattcttaatccagagagggttttcttttttttttttttgtaactgaagatggtgtaatacgatccattacat

SEQ ID NO: 407879 - DNA, 178 bp, Homo sapiens
gaaatcaagagcaaactgaacttctgagatatcaggtcaataactatggtttttttacaaatgcatctcaggaaagacaacttctagagtaggaagcaagttcatgaatgagaagtggatgctttcagaatcccatcttactcactttggatgagataaattaggattagcataaaca

SEQ ID NO: 407880 - DNA, 5568 bp, Homo sapiens
gttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaataacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataataatagctccatccctaaatgaggtgaatcttggaatctcttccattttattttattttatttttttgagatggagtttctctcttgttgcccaggctgaagtgcaatgttgtgatctcggctcactgcaacctctgcctcccgggttcaagcgattctcctgctttggcctcctgagtagctgggattgcaggtgtgcaccaccgcgcctggctaattttgtatttttagtagaggcggagtttcgccatgttggtcaggctggtctcgaacttctgacctcagtgatccccccgcctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataaatgactgtaatgtacatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccaccacagcaggcgctggagtcctgggaccaccaggatctgaggcccaaatccttcctcactaaggggaggagaggggtgctccggcagggcaggatgggaaggcgtgcttgggcgggattgtgacataagagtgccctggtgacatggagcagttctgtggcataaataaaggtgtcataaagacagggcgggactcatgcttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacaccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagaggctaccaatgagacagaatcttcccaagctcagcaggagaccccaattcagtttccagaggaggtggaaccttctgcaacccaacaggaggccccaattgagcctccagttcctcctatggagcatgaactttccatcagtgagcagcagcagccagttcagccttctgagacttctagggaggtcgaatcttctccgacccagcaggagaccccaggtcagcctccagaacatcatgaagtcacagtttcacctccaggtcaccatcaaactcatcatttagattcacccagtgtctctgtgaagcctccagacgtgcagctcaccatagcagcagagcctagtgcagaggtgggaacttctctagtccagcaggaggctacaactcggctctcagggtcaggtaatgatatagaacctcccgccatccagcacgggggcccacctctgctttcagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccgtctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctc

SEQ ID NO: 407881 - DNA, 4861 bp, Homo sapiens
gttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaataacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataataatagctccatccctaaatgaggtgaatcttggaatctcttccattttattttattttatttttttgagatggagtttctctcttgttgcccaggctgaagtgcaatgttgtgatctcggctcactgcaacctctgcctcccgggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccaccacagcaggcgctggagtcctgggaccaccaggatctgaggcccaaatccttcctcactaaggggaggagaggggtgctccggcagggcaggatgggaaggcgtgcttgggcgggattgtgacataagagtgccctggtgacatggagcagttctgtggcataaataaaggtgtcataaagacagggcgggactcatgcttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacaccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagaggctaccaatgagacagaatcttcccaagctcagcaggagaccccaattcagtttccagaggaggtggaaccttctgcaacccaacaggaggccccaattgagcctccagttcctcctatggagcatgaactttccatcagtgagcagcagcagccagttcagccttctgagacttctagggaggtcgaatcttctccgacccagcaggagaccccaggtcagcctccagaacatcatgaagtcacagtttcacctccaggtcaccatcaaactcatcatttagattcacccagtgtctctgtgaagcctccagacgtgcagctcaccatagcagcagagcctagtgcagaggtgggaacttctctagtccagcaggaggctacaactcggctctcagggtcaggtaatgatatagaacctcccgccatccagcacgggggcccacctctgctttcagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccgtctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctc

SEQ ID NO: 407882 - DNA, 337 bp, Homo sapiens
  misc_feature (336)..(336): n is a, c, g, or t
attttatttaaagatcctagtgactgatgcacattgtgcccctgttgctacgataggagcggaggatgttggatctgagagatctcatgcttaacccttaagtgagaagtagcgtgtggtgtgggaaggtaacacagctctctcctgtaagcagaaatcaagcggtggtctactgagagccattttattacttccagagaaccctgaaggtgaaatgaaggttctggggcagggagggagcatgaagtacgaggaaaacttgaattccagatttttaatgcaaagtatttatcatttctaccagaaataaacgttttaagtttttacttgaatatna

SEQ ID NO: 407883 - DNA, 398 bp, Homo sapiens
tgggcagacagcaaccttttgcttgccaagactcaaaccttcttagctaacagaacctccccaccttagccgtcagcacattcatgatccaagtaagcccagttactctagccctgtcactgcatcttaaaccagctctgtctgtgagcaagttagttccaaaagtatattgatttttcctgaaaagatgggggctgattccagggcttgcctaacctcttagggatggtaataatgataataataaacacatagtccttacatcttgcccagggcactgttcacattaggcgcttacagcactctcagtagggtactatttaatatatctactttatagtgagaaaactgaatcaaagggagattaactacctctcccaaggtgacatactcaggtg

SEQ ID NO: 407884 - DNA, 385 bp, Homo sapiens
tggaatatgtctccattagaggaaaaaattttaaactgttgaaatacttttccccttcttctccttctagaataacaggtttttaaagacaggacctgatacttatatatccttgaatgtctaatgtcaaacagtacctgacatgtagtaggtatttgatgactattaagtgaatgagtcagtaattgaaaacagatggttcacacagaagtagaaagaggcgttagttgtccaggtgatttggaagggagcagtaatgcatagtgggtggttatgttggatggaggagtgagtattctatagcagctttgagcaaaaactaatcttagttatttagaatcttgagtgtaggagaaatttattttcctttttatttatttattaa

SEQ ID NO: 407885 - DNA, 465 bp, Homo sapiens
ttttattatttatttatttatttatttatttagagacagagctggctctgtcacccactgcactccaacctgggtgacaagagcgagactccgtctcaaaaaaaaaaaaagaaaaaaactgcaggcaaagttggatttgcggcctatgaataaaaccattactttaaaaagtaatacccccaaaaaagttacacctgaagtttcatcttcatgcctttgtgtaatattactataatggtgaaatgatgatttaaaaaaaacacatcagaactgacacatcctcttgggatgatggggtccttcagtcaccttgtgaggcccatgtacttattccgttgatacagcctgtgcttattaaacatgtggggggccctccttgtgtgaggctgcttgaatggccagtacccccattcttttgaatattcccaatggcagtcaatcttggcctttaagaataaatttaaa

SEQ ID NO: 407886 - DNA, 1467 bp, Homo sapiens
acaaagcagggaggctagggtggccccggggcggggtcccggacccccaccctaaggcggagtgacgcccgcagtcacttcacaaggcaaaaattgttacggggcaataaaaggcacaacagcggccaatgtctggcagtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgca

SEQ ID NO: 407887 - DNA, 927 bp, Homo sapiens
acaaagcagggaggctagggtggccccggggcggggtcccggacccccaccctaaggcggagtgacgcccgcagtcacttcacaaggcaaaaattgttacggggcaataaaaggcacaacagcggccaatgtctggcagtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgagtcatgcatttcttgagcacctactgtctgccaggccccagagctcatggcgaagagacttgggcccatccctgccgaaaacgagacaattgaaaagtcaagtaaaataaaagaatgacatggaaat

SEQ ID NO: 407888 - DNA, 1657 bp, Homo sapiens
acaaagcagggaggctagggtggccccggggcggggtcccggacccccaccctaaggcggagtgacgcccgcagtcacttcacaaggcaaaaattgttacggggcaataaaaggcacaacagcggccaatgtctggcagtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgcacctggctctaacggtggcccccatttgcggactagtggagaagcgatcgctccatccggggaagtcatgcatttcttgagcacctactgtctgccaggccccagagctcatggcgaagagacttgggcccatccctgccgaaaacgagacaattgaaaagtcaagtaaaataaaagaatgacatggaaat

SEQ ID NO: 407889 - DNA, 2005 bp, Homo sapiens
acaaagcagggaggctagggtggccccggggcggggtcccggacccccaccctaaggcggagtgacgcccgcagtcacttcacaaggcaaaaattgttacggggcaataaaaggcacaacagcggccaatgtctggcagtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgcacctggctctaacggtggcccccatttgcggactagtggagaagcgatcgctccatccggggaaggcaggcgcgggtaccctattttagagtcacgcatgttgaggttattgctccaagactcaaaagggagtcgggaggattcgagcctggaccttttgagctccccagtatgggcaaactcaaaggagctttgttgtccccgggtcgtgatgtcgctgtgatgatgggctgggaagcaagtggaccccagcgcctcgccgtccacatcttttaagaatggaacagccaggggtggggcgagggtggcctgtctccacgtaaagtaggagtttatagataaggaaactgaggcccacatggatgtcacttgccaaaaggcagagccaagggccaggcgcggtggctcacgcctgtaaccccaacactgcgagtccgaagcgggcagatatcctgacttcgtgatccacccgcctcggcctctcaaagtgttgggattacaggcgtgagccaacgcgccctggaccctgcctcttaaaa

SEQ ID NO: 407890 - DNA, 454 bp, Homo sapiens
cttgtgcctcagaatcatcatagacgcttggaaatgggagagatcttcttatctcgttgctgatccaataccacagcatacacatggggaaactgagtcggtgatgaactattcactggcagtgccccccgctctgaattgggttttaagtgatgacaagtcggctgagcctcaggtttagaggaaacaccgtgtaggagcaggagcgaacgtttgctctgttcccgtggagcccatcatctacctgagacaacaaggcagatgtccgcataaacgccagggctgtccgtgctcaggggcaaatcagtggaataggtaatacaaagagaaaggcaggtgagagctcaatgggctaacacggtcaaggtaggcttcctgggggaagaggtatttacctggcccataaagaataggttgaagctgggcatggtggctcaagcctgtaagctgagca

SEQ ID NO: 407891 - DNA, 1601 bp, Homo sapiens
atggctgttacctaaatggctgttacctaaatggctgttacctaaatggctgtactcgtggatcacttgagcccaggactttgagaccaacctggtcagtacagtgaaactggtctctacaaaaaataaaataaaataaaaaagattcctagctgattctactgtgttgcaaaatttgggaaacaataaatgactgtggcctcgaagagaaagataagacacatcttataggaagcagaaagtgagacgtgccgttaaaaaagagagagagaaaataccacgggggtccttttgaataaaatgtgaccttgtttttagaaaatgcctcctgactttgagaattcccctttctgtctccagtcctctacgtgcaagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagta

SEQ ID NO: 407892 - DNA, 1901 bp, Homo sapiens
ccggtctctactaaaaatacgaaaattacccgagcatgatggcaggtgcccgtaatcccagctacttgggaggctgaggcgagagaatcgcttgaaccagggaggcaggggttgcagtgagctaagatcataccaccgcactccagcctgggtgacagagcgagactctgtctcaaaaaaaaaaagggggtcacattcagaggtggatctgaattttgagggacactattcaacccactgcatgtattgtcactgtaagccaggcctgtcaagaaagacgttttccaaaatgctttagttttgcaaatatttaccatgtccttgttagggacagggtcacattggatgctgggccctcgtgaggacaggaacatccaccctagccctgtcttcagatgagctcctctctgtcccaggcaggataatacaggggagggaggagagtaggtgagtggggaggggggtggcagcatggtgtggaggggtgaagggccacgctaggcagctggaatattctgcttcctaccttaacttacaccatctcagattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagta

SEQ ID NO: 407893 - DNA, 1141 bp, Homo sapiens
cttgtgcctcagaatcatcatagacgcttggaaatgggagagatcttcttatctcgttgctgatccaataccacagcatacacatggggaaactgaggccccaaaaacgaaggcaaattagtgacaggaggagaactggagcccaatccctacttgcctccatggctggaacctcaaagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagta

SEQ ID NO: 407894 - DNA, 1784 bp, Homo sapiens
atggctgttacctaaatggctgttacctaaatggctgttacctaaatggctgtactcgtggatcacttgagcccaggactttgagaccaacctggtcagtacagtgaaactggtctctacaaaaaataaaataaaataaaaaagattcctagctgattctactgtgttgcaaaatttgggaaacaataaatgactgtggcctcgaagagaaagataagacacatcttataggaagcagaaagtgagacgtgccgttaaaaaagagagagagaaaataccacgggggtccttttgaataaaatgtgaccttgtttttagaaaatgcctcctgactttgagaattcccctttctgtctccagtcctctacgtgcaagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagtatctcactgtggagtgcaatggcgagcatgaatccctgcacagtcacagaatgacgtcggccacgagaggaagtggagaaatgccaagcaacacagttttgctccgggctggcccacagccgcctgcgtgacgcagctacagcagcccagtttctcctgaggggtagggcaagttccagcagca

SEQ ID NO: 407895 - DNA, 303 bp, Homo sapiens
actttgggaggccgaggtgggaggatcactcgtggatcacttgagcccaggactttgagaccaacctggtcagtacagtgaaactggtctctacaaaaaataaaataaaataaaaaagattcctagctgattctactgtgttgcaaaatttgggaaacaataaatgactgtggcctcgaagagaaagataagacacatcttataggaagcagaaagtgagacgtgccgttaaaaaagagagagagaaaataccacgggggtccttttgaataaaatgtgaccttgtttttagaaaatgcctcc

SEQ ID NO: 407896 - DNA, 317 bp, Homo sapiens
caaaagctgtaagtctaacagaagcattgccctggaggactggctgcaggcagagggcttgccccgcaacctgctgtgccactgagggccctgggtcttgtgatctgctgcttctcccgcccagcccctccctctctctgcccagtgccgggggaagacatttccctccatccacctgtggacccggctcctgtcggccactggctggcctcctctatgcctcggccattgtggcccacgaccggcaccctgagtacctgctgcgggccacaccctggttcctgacctccctcggccgtgcggcactggacctcgct

SEQ ID NO: 407897 - DNA, 1499 bp, Homo sapiens
ggcacgaggtcacaatccaggttttcactggctggcctcctctatgcctcggccattgtggcccacgaccggcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagta

SEQ ID NO: 407898 - DNA, 1532 bp, Homo sapiens
ggcacgaggtcacaatccaggttttcactggctggcctcctctatgcctcggccattgtggcccacgaccggcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagcagaagtattgggaggccctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagta

SEQ ID NO: 407899 - DNA, 697 bp, Homo sapiens
atggctgttacctaaatggctgttacctaaatggctgttacctaaatggctgtactcgtggatcacttgagcccaggactttgagaccaacctggtcagtacagtgaaactggtctctacaaaaaataaaataaaataaaaaagattcctagctgattctactgtgttgcaaaatttgggaaacaataaatgactgtggcctcgaagagaaagataagacacatcttataggaagcagaaagtgagacgtgccgttaaaaaagagagagagaaaataccacgggggtccttttgaataaaatgtgaccttgtttttagaaaatgcctcctgactttgagaattcccctttctgtctccagtcctctacgtgcaagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctccaatggtgcagcagctctccaaggttgcagcatg

SEQ ID NO: 407900 - DNA, 2167 bp, Homo sapiens
  misc_feature (1)..(1): n is a, c, g, or t
  misc_feature (6)..(7): n is a, c, g, or t
ngccgnngctcggatctaggagctactcgcccggccctgggcggtgggaggcggcggcggcggcggcgctcgcgcacctcggaggagccaggagccggaaccagggccgagcccgcgggccggggctagccagccggtcggagatgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagacaatgcagagtcctcagagaagagattcagaatgaacagctttgtgtcagactttggaagacctctggagccagataaagtattttctcgccaaggcaacgaggagtccaggtctctctttcactgctacatcaatgaggtggaacgcttggacagagccaaagcttgtcaccagaccacagcccttgacagtgacgtccaactccaggaagccatcagaagcagtgggcagccagaggaggagctgaacaggctcatgaagtttgacatccccaactttgtgaacacagaccagaactactttggggaggatgatcttctgatttctgaaccacctattgttctggaaactaagccactttcccagacctcacacaaagacctggattgagaaacatgctctgtaaagggtcttcctgaagatgtggattctatctttatgtagcaagaaatctacatccaccaaaattgtgtgtgtttgggggagagagagacatagagatagagacagagaggcagagaagagacccctttagaagagagctgagctgattaagctgagtggttttttgttttgttttgtttttgctttttaatacatttggagctttgggagtattaaagtatttacaccaagcttgtccaacccgtggcatgtgtcccaggacagctttgaatgtggcccaatacaaattttaaactttattaaaacatgagttttgtttttttttttgctattttttttaaagctcgtcagctatcgttagtgttagtgtactttatgtgtggcccaagacaactcttcttccagtgtggcacagggaagctaaaagattggacacctctgatttatactagctcgttttgcttgttgaaaaatttggccaaatacctattgtcagcattcttgggtgaggattagcctaccatgttctaatctggccctgccactactatgctctacctttggtgagttgctttacctctctgggctgccccatttttaactgtaggttgacaggtctagagtgatccatcccacctctaatattttgtgaatttatgactttgccttcagatgaggctgagctatacataaaacagtataaactagggtactgcctcgtatctcttgtaggctctctcaaatctctgtaccttccacttaaccctaattgagccaagctttagtcaggggatctggttgtctaccagaatgtcaggagactcatcttacacagtcatggtggccaatgtttctggtgggttgtgctgaaacagctcttctgagaacttccaaccacccatgctctaacctggagacagccatcccctgcctcagaataagtaccaattcgtagtacatgtatggtactcttgtccccaagaaatgttaggaagcttgtcagctgaatgagaggaggtgccttctgggtatctctgtgttggtgtatctgtgccattggctacagaacaagaaaaatactatttgccatgctattaccttggcagatgtgtaggtgatagtcatctggctttgagctgagatggtcagtgggttgtaaattccccactagcagatattcagggtggcctgagttatgtaaacaagtgagcaacacagctttaatttcatggaggaatcaaagctgcacactggtattaaaacaacttgattttgcgcacacagttgcatgcatggcaagctgttaacctctgggtggcattttcattatgaatttgccctcccccttgggacgcgctgtaaataattgcaataaaacaaacctttctctg

SEQ ID NO: 407901 - DNA, 68 bp, Homo sapiens
gtaagtttgggctgttcctaaatgtctcttaagcctcacaggagactgaggaaatagaaactactacc

SEQ ID NO: 407902 - DNA, 2166 bp, Homo sapiens
  misc_feature (1)..(1): n is a, c, g, or t
  misc_feature (6)..(7): n is a, c, g, or t
ngccgnngctcggatctaggagctactcgcccggccctgggcggtgggaggcggcggcggcggcggcgctcgcgcacctcggaggagccaggagccggaaccagggccgagcccgcgggccggggctagccagccggtcggagatgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagacaatgcagagtcctcagagaagagattcagaatgaacagctttgtgtcagactttggaagacctctggagccagataaagtattttctcgccaaggcaacgaggagtccaggtctctctttcactgctacatcaatgaggtggaacgcttggacagagccaaagcttgtcaccagaccacagcccttgacagtgacgtccaactccaggaagccatcagaagcagtgggcagccagaggaggagctgaacaggctcatgaagtttgacatccccaactttgtgaacacagaccagaactactttggggaggatgatcttctgatttctgaaccacctattgttctggaaactaagccactttcccagacctcacacaaagacctggattgagaaacatgctctgtaaagggtcttcctgaagatgtggattctatctttatgtagcaagaaatctacatccaccaaaattgtgtgtgtttgggggagagagagacatagagatagagacagagaggcagagaagagacccctttagaagagagctgagctgattaagctgagtggttttttgttttgttttgtttttgctttttaatacatttggagctttgggagtattaaagtatttacaccaagcttgtccaacccgtggcatgtgtcccaggacagctttgaatgtggcccaatacaaattttaaactttattaaaacatgagttttgtttttttttttgctattttttttaaagctcgtcagctatcgttagtgttagtgtactttatgtgtggcccaagacaactcttcttccagtgtggcacagggaagctaaaagattggacacctctgatttatactagctcgttttgcttgttgaaaaatttggccaaatacctattgtcagcattcttgggtgaggattagcctaccatgttctaatctggccctgccactactatgctctacctttggtgagttgctttacctctctgggctgccccatttttaactgtaggttgacaggtctagagtgatccatcccacctctaatattttgtgaatttatgactttgccttcagatgaggctgagctatacataaaacagtataaactagggtactgcctcgtatctcttgtaggctctctcaaatctctgtaccttccacttaaccctaattgagccaagctttagtcaggggatctggttgtctaccagaatgtcaggagactcatcttacacagtcatggtggccaatgtttctggtgggttgtgctgaaacagctcttctgagaacttccaaccacccatgctctaacctggagacagccatcccctgcctcagaataagtaccaattcgtagtacatgtatggtactcttgtccccaagaaatgttaggaagcttgtcagctgaatgagaggaggtgccttctgggtatctctgtgttggtgtatctgtgccattggctacagaacaagaaaaatactatttgccatgctattaccttggcagatgtgtaggtgatagtcatctggctttgagctgagatggtcagtgggttgtaaattccccactagcagatattcagggtggcctgagttatgtaaacaagtgagcaacacagctttaatttcatggaggaatcaaagctgcacactggtattaaaacaacttgattttgcgcacacagttgcatgcatggcaagctgttaacctctgggtggcattttcattatgaatttgttcaccacctgtcttgcttaagctacaaaataaatgcatttgactgcaagaaa

SEQ ID NO: 407903 - DNA, 1839 bp, Homo sapiens
agcggacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagaaaataactccttaaaga

SEQ ID NO: 407904 - DNA, 588 bp, Homo sapiens
tccatatttctgttttgacctgtgaagccccattcaaaacttagggggaaaaacctttaaaaaatttatgtctgtttgttctcgtgtttgtctattttgtgttttgtattccaaaacataggttaagttttccaacatttctttttcattacctcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtaagtaaatcagctttagggccgagcaatgtagagaaaagagcagaactttcaagccactggctgagaacctgacactaccatttactacactaatcactttcatactgaaaaccaggatgaaggagttgaaagatgggaataataatacctatctagcagggttttggtgaaaattggagattatatatgtaaaagatctagtatagtatttggcatgta

SEQ ID NO: 407905 - DNA, 2387 bp, Homo sapiens
agcggacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggtaaaatgtttactttgatcattcctgcctctccctcttcttttcaccaaagcatctgaaaatgtgtcaactcttgattaggtaagagctgtaatgcagattggcatcctgtctgtttgctttagagtgcatatcgtgcttatattatcaccgataagccagacatgccaggaattcacaacacattaaatcacaatactgaggtcatgatgtaatcatataattccttcccatccccatccttgaggtaatttttcctttgtctgcttattatgtggcttttatttaggatgaagcccctggttttgtgctttgatataaggacttctcctgtttgctgagtacagatctcctgcctgccttaaggctaagtggggaatatgtggttcacagagatgataatgctggttaaggaatgcaaagctggcagctggaggtctggataattgaaaagcgactataggcttagtctttaccttatgtatatgccaggtctccaatcctgtctcccaggttcaatgacatatattgttttgggtttgtaacttgatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagaaaataactccttaaaga

SEQ ID NO: 407906 - DNA, 1988 bp, Homo sapiens
tggcagaaggtgaaggagataagcaggaggtgggggcagtgccacactttaaaaccatgagaaattgtgagaactcactatcatgagaaccgcaatggggaaaaccacctctgtgatccaataacctcccaccaggtccctcccgtgacatgtggggattacaattcaacatgagatttgggtgaggacacagagccaaaccatgtcataaataaagagtgtttaggcatcagtgtgctattctggatcttcttccttcaggttcaaaaacttcagcgagcagctctgaagaatcctgtgaaatgtgccgtttcctctaaataccagacagttgaaaaattacagcaatattatatttttattccctctaaattcaaggtaaaatgtttactttgatcattcctgcctctccctcttcttttcaccaaagcatctgaaaatgtgtcaactcttgattaggtaagagctgtaatgcagattggcatcctgtctgtttgctttagagtgcatatcgtgcttatattatcaccgataagccagacatgccaggaattcacaacacattaaatcacaatactgaggtcatgatgtaatcatataattccttcccatccccatccttgaggtaatttttcctttgtctgcttattatgtggcttttatttaggatgaagcccctggttttgtgctttgatataaggacttctcctgtttgctgagtacagatctcctgcctgccttaaggctaagtggggaatatgtggttcacagagatgataatgctggttaaggaatgcaaagctggcagctggaggtctggataattgaaaagcgactataggcttagtctttaccttatgtatatgccaggtctccaatcctgtctcccaggttcaatgacatatattgttttgggtttgtaacttgatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagaaaataactccttaaaga

SEQ ID NO: 407907 - DNA, 1103 bp, Homo sapiens
agcggacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggaatgtcaaagttggcggccgc

SEQ ID NO: 407908 - DNA, 1303 bp, Homo sapiens
gtatttttagtagagatggggtttcagcatgttggccaggctggtctcgaactcctgacctcaagtgatctacctgccttggcctcccaaagtgctgggattacaggtgtgagccaccacatctggctcagcaaggtttcactctgttgaccaggctggagtgcagtgacttgatcatagctcactgcagcttcaaactcctgggctcaagtagtcctcatacctcagtctcctgaatggctgggattacaggcacatgccaccacggttggctaatttttaattttttatagagatggcatctcactgtgttgtccaggctggtctggaactcctggtctcaagtgattctcctgctttgacctcccaaagcgttgggattacaggtgcaagccaccatgcctggcctcccttgagtgattttctaatgggctatgcacagagattgcacttaacccatatttagaaaagaaataatatgttcaatattgtttaaacctatggttcctattgcgttgtatcatataataatagtttgggaatggacaggcatttgcgttaccaggcaaccagagctgtgcagttttccttcctcaggtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagaaaataactccttaaaga

SEQ ID NO: 407909 - DNA, 406 bp, Homo sapiens
cttcctcaggtatgatgtggaactcttccagcgcatagaacacttaattgggaagaaactaccaggttttccaacacaggatgatgaggttatgatgctgacagaacgcgtcgctgaagcccaaaggtttgcccgaatggtatgcatctttcttttctcaccagtgtctgtgcaaacaatgttaactgtgtgccactttattatattaaccctcatactaaactgcagaagctgggtattattttattccaaatttaagacgagcaaactaaggtgcagagatggtaggtaatttgcattagaccatacaaccaaatggttgaatcaaggtttggcctcattctgacattcacacattcacagcacctgttcatgtgtcgcacgtggtgagatagttcatcagact

SEQ ID NO: 407910 - DNA, 1692 bp, Homo sapiens
agcggacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagaaaataactccttaaaga

SEQ ID NO: 407911 - DNA, 1812 bp, Homo sapiens
agcggacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgcgtatacactgatgaacatattattctcccctctcctctcg

SEQ ID NO: 407912 - DNA, 1495 bp, Homo sapiens
agcggacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatgatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagaaaataactccttaaaga

SEQ ID NO: 407913 - DNA, 1272 bp, Homo sapiens
ggagacggcatgaatcgagctcggtaccatctcgtgctgggattacaggcacaagccacctgcctggccgatttttgtttctttttctttttttaagcagcaaggtttcactctgttgaccaggctggagtgcagtgacttgatcatagctcactgcagcttcaaactcctgggctcaagtagtcctcatacctcagtctcctgaatggctgggattacaggcacatgccaccacggttggctaatttttaattttttatagagatggcatctcactgtgttgtccaggctggtctggaactcctggtctcaagtgattctcctgctttgacctcccaaagcgttgggattacaggtgcaagccaccatgcctggcctcccttgagtgattttctaatgggctatgcacagagattgcacttaacccatatttagaaaagaaataatatgttcaatattgtttaaacctatggttcctattgcgttgtatcatataataatagtttgggaatggacaggcatttgcgttaccaggcaaccagagctgtgcagttttccttcctcaggtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagaaaataactccttaaaga

SEQ ID NO: 407914 - DNA, 1300 bp, Homo sapiens
atctctccttaatcagccataaagcaaggaaaaggcaaagcgctattcacatagtgtgggcacactgtccttgatttctctgagaagatggtttgagtgcgagcctccgtagaggagagagtgttgaggtgcccacctttgagtgtttgtgtgagcccctgaaggtggaaagtgctatgtaagtgctgagctattcagcttcccaggcgagagaagatgcttatcttattcatccctcttttatttgtaaaatcttttttgtctcttgacaggtgatcttttttttttcctggaaaccaattagctactaaaattaaacatgcttctctttaaattaatccttttcataaaatggtcttaaaattggccttagcttctcagagtaagtagctgaccccattgtaattagagatgcgtttggagtcctcatttctcccacctcggcattcctctgcccttccccctgctgctgccaggtgctgtccaccttcgggctttcggcgccaccggcctcatcttggcaaaggtcagatgtcggctctgggacagccgtcagattatctagttctgctgcccaagtgcactgacagcaactggcagagttgtaatcactgtaaattcaggtgacggtcagatgagccaggagagaggatgcctgctggttgtttttttgcagtgatgtattgtttatgggattaatgttccgaatggccaagggtgtcagctgatatttattactgtaagctgtctcagctgttcaggttcggcagctagatccatggccacaggaaatgtgggactcggtggcatgtccagtatggctgatgtgtgcagatgtagctgggacctccgtgagcctctgttacagatgcaaggggaaggactcatggcagcagctgccttggattttgttcagggcttctgagggaactccacacactcttgaaggttggggagactctagggaaggggagagtgtccaggtttggctccaaagggggttgggaaggagttcacctctgacaggcctggcatccgtagaaattatgctgcctgccaggtagctgtaggcattgtgtgatttttaccttggtccctcttcagccttctaagagagggcgctttcaaggtcattgtgcctttaagggaaccttctccccagtccctctggatgctggtgcttaaagctataagaagcgggccagacccttttaaacctatctggagtgctgcaggaagagaagtaaatgcacatcgccctggtgtgtgcctcgcaacactcactgcagtaggtttgttt

SEQ ID NO: 407915 - DNA, 647 bp, Homo sapiens
  misc_feature (246)..(246): n is a, c, g, or t
  misc_feature (259)..(259): n is a, c, g, or t
gcaaaatcaggttttctgattccaaatcccgtgttcattcagctgcatcaggaatcaggccattccgctcctagtattagcagcaataacaaaacaggaacagcagctgatgtgtatttggtgctgtaccatgtgccagtctctttaaaaatattatctctcagggtagatgctagcattctattttacatccccgagaaaacttaaaattatcagggttaaataactttccaagatcacacagcnagtatatccacanagcaagtatttgaaccaggtttggctgagtctagagacgatgttcttaatatgccactttgctagagtggcctttgaagtgctctttgaaagacagtttgtaagatgaaaatattcttttagatatatttattgagattttagtcagaaatggatttcttgcccattaaaagcactagtgccctacaaagtgctctattaaagtcctatttttcaggcacaacagatggaggacagatgtttctttatgctctgaaaggtccactttatgtagctgactataataagattgtatctggttccgaatgtttcagagaaatggtatcaggcagatcattgtaaatgaaagccaaatcaaaggcattattgcacagatttgatagaaaaaa

SEQ ID NO: 407916 - DNA, 2235 bp, Homo sapiens
  misc_feature (1)..(1): n is a, c, g, or t
  misc_feature (3)..(3): n is a, c, g, or t
  misc_feature (9)..(10): n is a, c, g, or t
  misc_feature (20)..(20): n is a, c, g, or t
  misc_feature (226)..(226): n is a, c, g, or t
ngnagaganntgaccccctngggggcgctgcctctccctcactcacacactgcacgtcaccctgtttggccccggtggatggctggttagccagagacgggtaagattcctcagggaaggaacaacctaagacaggcacagtcgcagaggggccatcaggagagaacttgggggcaacagaggtggggcatggaccctcacccccacaatcctacaggggcctganccctcacaccttctgagggaggtctcctgcccccatggctgctttgcttcccacgcccagttcagatcgggacccaggtagcagacagagacctggccaacagcaagtgcccactcaccacagcaaggatttgtttctcatttctaccttggaccacagggatggggcagctgaaagaaagggctgtgtcagggtgtctttctcccttttctccctcatttttctagatgcttttttgccttgtagttctttctctttttctttgctttctctttcctttttctgtctgtctcctatacctcccatctctcccttgcccctgccccatcttgcctttttctctttttcctccttttcctttcttattcctttgcctctcctcttcctgagccccacctgctcatctccctgccccaacatcctgtgccatccctgtggtgtgtttgggtcttggccaaagccagacctggcagaactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccggcaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctccctggtgccaggaagccaaagcttactttgtagaactgacactaaactacccgaaggacttaggtgctttgtgtacttaaccccaggacctccttactttttaatataaagagtgatgttgt

SEQ ID NO: 407917 - DNA, 1490 bp, Homo sapiens
  misc_feature (1)..(1): n is a, c, g, or t
  misc_feature (3)..(3): n is a, c, g, or t
  misc_feature (9)..(10): n is a, c, g, or t
  misc_feature (20)..(20): n is a, c, g, or t
  misc_feature (226)..(226): n is a, c, g, or t
  misc_feature (1456)..(1457): n is a, c, g, or t
ngnagaganntgaccccctngggggcgctgcctctccctcactcacacactgcacgtcaccctgtttggccccggtggatggctggttagccagagacgggtaagattcctcagggaaggaacaacctaagacaggcacagtcgcagaggggccatcaggagagaacttgggggcaacagaggtggggcatggaccctcacccccacaatcctacaggggcctganccctcacaccttctgagggaggtctcctgcccccatggctgctttgcttcccacgcccagttcagatcgggacccaggtagcagacagagacctggccaacagcaagtgcccactcaccacagcaaggatttgtttctcatttctaccttggaccacagggatggggcagctgaaagaaagggctgtgtcagggtgtctttctcccttttctccctcatttttctagatgcttttttgccttgtagttctttctctttttctttgctttctctttcctttttctgtctgtctcctatacctcccatctctcccttgcccctgccccatcttgcctttttctctttttcctccttttcctttcttattcctttgcctctcctcttcctgagccccacctgctcatctccctgccccaacatcctgtgccatccctgtggtgtgtttgggtcttggccaaagccagacctggcagaactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccggcaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtcgctatgnngaggccgtcctcatttttttttttttttttttt

SEQ ID NO: 407918 - DNA, 2164 bp, Homo sapiens
atggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccggcaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctccctggtgccaggaagccaaagcttactttgtagaactgacactaaactacccgaaggacttaggtgctttgtgtacttaaccccaggacctccttactttttaatataaagagtgatgttgt

SEQ ID NO: 407919 - DNA, 1419 bp, Homo sapiens
  misc_feature (1385)..(1386): n is a, c, g, or t
atggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccggcaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtcgctatgnngaggccgtcctcatttttttttttttttttttt

SEQ ID NO: 407920 - DNA, 1353 bp, Homo sapiens
atggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccggcaagggctcctggatgcctaccatgatggggcctgctgttccctgagcattcctttcattcctcagaaccctgcccgaagcagcatagcctcttcttcctttgtaaatgataattcactgctagcctcccccaaccccccctgc

SEQ ID NO: 407921 - DNA, 2056 bp, Homo sapiens
atggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagttgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccggcaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctccctggtgccaggaagccaaagcttactttgtagaactgacactaaactacccgaaggacttaggtgctttgtgtacttaaccccaggacctccttactttttaatataaagagtgatgttgt

SEQ ID NO: 407922 - DNA, 1017 bp, Homo sapiens
gcctcagcctccccagtagctgggactacaggtactatgcaatttacgactctggagaccggcaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctccctggtgccaggaagccaaagcttactttgtagaactgacactaaactacccgaaggacttaggtgctttgtgtacttaaccccaggacctccttactttttaatataaagagtgatgttgt

SEQ ID NO: 407923 - DNA, 398 bp, Homo sapiens
gagtagaatattttacagctcaaaactggaagagcttaataataaatgtgagacaaataatacacggaccctatcttagtaaagaaagtcatcatcatcctcagatgcctttagaaaagactcttttcatctagcataatagtatactattaacaagtttatctagtttaatctgggcataacatgtgaaaatgtcatttttccaatgatagaaacagaattgtattgttttcaccaagaaacaaacatatgtttcagtaaaaaagagaaaattgaactgctttcctttaagtacctataaaaattttaacgtaagattataagtaaaatgaggcttgttaagcttctagaaatcagattaagatatttaaaataaaaacataactgtgggtctcagg

SEQ ID NO: 407924 - DNA, 270 bp, Homo sapiens
gcccgaagcctgaacaggtgaagtgacttttcctaaggtcgcacggccagtaagcggcaaagcacaagtgccctgtcttccagtctggtgttccttccaccacaccacactgccaggaggtgtgtgtgtgtgtgtgcgtgtttgtttgtttgtttagtgggaaacaaatttcgtgttgccctaggtcttcctgggatatggggacaaatacagtaagaataatccttcccaatcttcttgccccaaataaagatgaactgtctatgggca

SEQ ID NO: 407925 - DNA, 1056 bp, Homo sapiens
gtgggagtatataaaaggctaatgtctatctcacgacagatagaaattaaattcagataaatgaataagcaaaaaactatagaaaagttagaacaaaatacaggatttatatatttttggtaaaataggcacaaaactcaggaaccagtaagaattaaaacagaagcacattaaggaaaaataaaactccatatgataaaagacaccataaacaaagttaaaaacataccaacattggaggaaatatgtttaatatagaaataaaagattgaagagcatgtgtgtctgtgcatgcatgcatgtgcatatttggtgtaaggttttcaaaagaataaaatagatgttactgtccctacagaaccccaaatgattcagaaaattaaccagacactgaaaaaagtatggagaaaaggggaagaagacaagaaggtaatgaaatgaagacagaacgtttagaagaaggtatacttaatgaatcgtgagaaatcttcaactttcccgcccagctatggggatttcagaagctaggtgtccattccccaagtaaataaaattatccttttctaaacaaactgcttggctcaggaataagatataaggttactatcactgggaatccaccagcaaaaagagtggccacatgattacactactgtgaaacaccataggccaactgacaatgccccatacaaaacacacagtgcttccatatgcttgtgttttgttttgtttgtttgtttgtttgtttgtttgtttttgagacagggtctcgctctgtcacccaggctggagtgcaatgtcacgatctcagctaactgcaacttctgccttccaggttcaagcaattctcctacctcagcctcctgagaagaatggcgtgaacccaggaggtggagcttgcagtgagccgagatcgagccactgcactccaccctgggggagagagggagactctgtctcaaaaaaaaaaataataataatctgatggaagatgttaaaaatccaatacaagggtcaaggaaatacctcaaaaagccagacaaagtctaagatatg

SEQ ID NO: 407926 - DNA, 772 bp, Homo sapiens
agacagagtctcgctctgtcacccaggctggaatgcagtggcatgatctcaactcactgcaacttccacctcctgagttcaagcaattttcctgcctcagcctcctgagaagttaggattacaggtgtggtggcgggtgcctgtaatcccagctacctgggaggctgaggcgggagaatcgcctgaacctgggaggtggagattgcagagagtcaagattccagcctgggtaacagagagagactccatctcaaaaaaaaaaaagaaaatgtgagtgtgggagctacctgctgcctggatgtcagtttgacagcactggtagtggtagtaatggagtgagtgctgcattgagtgcttcctgtgtacctaagcattatgatgagggctttatagacacttttcattctcaaaacaagctgaagagaggttaccacattttacagagtataagactgaaactgtataattagttcaagatcacgtagtaagatacagagctggaatttgaatatagtctgttaattccaaaactggtattcttaagtgttgataaagaatttcttcatgagcaccgcagatattggtcctggaagaaattttggcctcaaaggcagctctctcccacctggatactttttgtccctacagatagtaaactgtaacattaaaattaaatctgtaattggttatacagtaataatgtcacgggcacagtacttaatgtaacatgcctttttgagaaatgtctttgacttagagcaataggaatcta

SEQ ID NO: 407927 - DNA, 770 bp, Homo sapiens
aggggtcaggtgaggttgcagtggggttagtcggtcaatagtttctttatgccaattaggatttctgcagaaaacaatgaaatactggtttaaacagtaaaaatattttaattccttacagaagcccatggaacatacactccaggtttaattcatcagctcaatagcatcatcaatgacttaggttctttccactttctgcttgtcatctgtgttggctttattttcaagctagctcctccctggttgcaagataattgcagcaggtttagttatcatattcggacatgctaacgcccagggtagtgatcccttccttgcatttctttctcattttaagaacaaagtgtttaaaaaattatacttaaaattattggcatctctgtcaattgaaagatgtcaatctctttcatttttcctaatcactaataacatctactaaaaacaaaatgtctgtgtaaataatttatttgaataaaattaaagttgttgagtgagctcggcttttgaggagtgggaaaggaggggtgcatagattagtggaagatgagaagctagtggggctcaagtccagcaggagcaggagtttggagccaggacttcctagcctctcagggtttttttttaacttccttacctgaaatgatttgtgctatataacttgtcctggctaaactttcttaatctcaactgtttcatttaatcaataacaactactgcgccaccttcataatatcaattttcagcatttcatttactgaatatcattt

SEQ ID NO: 407928 - DNA, 2890 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407929 - DNA, 615 bp, Homo sapiens
aaaaaaaaaaaaaaaaaaaagaattaaatgaaatcaactgtgtagagttcttagtgtaggacatagtacaaaagtatactgttatctcccagggcacccagtgcaaggctctttatctcatcccgcttgggtgtacctggttaccctcagtgaccctcattactgccagacgtatgttgtttacattacccctgcctactgttcctttccctcactaaggctgattctcaagagggaattcaagagagaatgccaatctaacactgttcttttctgtcctcgttggtcactcagactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagaggtaactgggggaaaagaatgttgggggatggaaggggtggttattcccattttcaccagtctccatgtcccctgcctgagacctcccaacctgactcctgaacactttgtatttctctttata

SEQ ID NO: 407930 - DNA, 429 bp, Homo sapiens
aaaaaaaaaaaaaaaaaaaagaattaaatgaaatcaactgtgtagagttcttagtgtaggacatagtacaaaagtatactgttatctcccagggcacccagtgcaaggctctttatctcatcccgcttgggtgtacctggttaccctcagtgaccctcattactgccagacgtatgttgtttacattacccctgcctactgttcctttccctcactaaggctgattctcaagagggaattcaagagagaatgccaatccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407931 - DNA, 373 bp, Homo sapiens
ttactgaaccccaagaccctaccctctgggctggagagtgactgtagagccgactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacaccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407932 - DNA, 2564 bp, Homo sapiens
ggcggagaggtccggcgggaggcggaggcggaggcgcaggcgctggctggcaggtgtcgctaaccggacggtggtcgccagggcgagaggcgggagccggagagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407933 - DNA, 2663 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407934 - DNA, 2434 bp, Homo sapiens
aaaaaaaaaaaaaaaaaaaagaattaaatgaaatcaactgtgtagagttcttagtgtaggacatagtacaaaagtatactgttatctcccagggcacccagtgcaaggctctttatctcatcccgcttgggtgtacctggttaccctcagtgaccctcattactgccagacgtatgttgtttacattacccctgcctactgttcctttccctcactaaggctgattctcaagagggaattcaagagagaatgccaatctaacactgttcttttctgtcctcgttggtcactcagactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407935 - DNA, 2245 bp, Homo sapiens
ggcggagaggtccggcgggaggcggaggcggaggcgcaggcgctggctggcaggtgtcgctaaccggacggtggtcgccagggcgagaggcgggagccggagaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407936 - DNA, 2910 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactctaaaaaaaat

SEQ ID NO: 407937 - DNA, 1650 bp, Homo sapiens
gtcctcaagcagattgggctacaggccaaagtaagggttggggggttggcgtggactgctcgttgtactaggaatttctggaggcacccgggctcgggcctcatcccccagtatctgctccgtgccaacgtggtaggcaatgtatggcgccagtaccaggctacaggctttctttgggagcagtacagtgaccgcgatgggcgaggcattggctgccgccctttccacggctggaccagccttgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407938 - DNA, 2057 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgacctgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407939 - DNA, 1924 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407940 - DNA, 1944 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactctaaaaaaaat

SEQ ID NO: 407941 - DNA, 1208 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcaggccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407942 - DNA, 718 bp, Homo sapiens
aaaaaaaaaaaaaaaaaaaagaattaaatgaaatcaactgtgtagagttcttagtgtaggacatagtacaaaagtatactgttatctcccagggcacccagtgcaaggctctttatctcatcccgcttgggtgtacctggttaccctcagtgaccctcattactgccagacgtatgttgtttacattacccctgcctactgttcctttccctcactaaggctgattctcaagagggaattcaagagagaatgccaatctaacactgttcttttctgtcctcgttggtcactcagactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagaggtaactgggggaaaagaatgttgggggatggaagccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactctaaaaaaaat

SEQ ID NO: 407943 - DNA, 2693 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407944 - DNA, 2835 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacgtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407945 - DNA, 3366 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacaaaaaaaaaaaagacccacaacaccggagaggacaacatatgccgcgaggttcggggaaaaagagggacatgaaacgggcacagtggacaaaccggtgttcccacggacccaaaccatccataggcccaaactgggacaaacacagccggcccccccaaaacagagaacaaacaaacactcacacaaaaacgccccagggtaaaccccggcatacaattggaagcggggaaaagccagagaagagaagagaacaccacaacgacacacaaagagagaacagagcacggacagccaggcgaccacaacaccaacgggaagaaccgaaaacgcggccagaaaagacaagaaaaaaccacacaacacaagagcaccacaacaaccagcgaacaaagagactccaaaacaaacagacaagagaaaaacaggacaagaaccgcgaacaaaaagaaccaacaggcacagcaagaaaaaagcat

SEQ ID NO: 407946 - DNA, 2337 bp, Homo sapiens
ggcggagaggtccggcgggaggcggaggcggaggcgcaggcgctggctggcaggtgtcgctaaccggacggtggtcgccagggcgagaggcgggagccggagagccccgccgtggccccggacctcttctggggaacctaccgccctcacgtctacttcggcatgaagacccgcagcccgaagcccctcctcaccggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407947 - DNA, 1997 bp, Homo sapiens
tgcccactgccttctcttgaataatatttcctatttatcttctccccttcaagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407948 - DNA, 2536 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccacccacgattgtttatctggagagagacctcaacagggtttctcctggaaaaaagccccaaagggtt

SEQ ID NO: 407949 - DNA, 2003 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgtgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407950 - DNA, 1314 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggcctgggaacatgtggagtttaagagggttgaaaaactccatgaggaaagctggattggagagttgg

SEQ ID NO: 407951 - DNA, 1154 bp, Homo sapiens
ggcggagaggtccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagaggtaactgggggaaaagaatgttgggggatggaagccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 407952 - DNA, 716 bp, Homo sapiens
cctagcaggcatctaagataaagaaagcaatgattcggaagtccagtagggcccatttgaccggtagcaaaatcgaaagcacgaaatagatcaaggttagggagccagacaaagcccttggaagagaggcagtattgcagatcgaagcaagcagttcagagtctatgaggcctgggaatttaaaagcaggaagagtaagaagcagaaacaagaagctccatctgaacagactcctctctccaaccttcatgagacccacagtgtgtgatgggccaccacagcactggcttctagacttttacagggaagccagtgaacaaattacctcgtcacccagaaaacaaagagctcaggaactattttggaagttccttccagtctaagactatggaactcagaatctagcaggtgtgttcctttggatagcaaaactaaagatataaatatgaataagaaattctttgccacttctcctgggcaaggttatactttatgccatctactgagataaaccagatgagtcagtttgcttctgtcagttgctgtgtcacagatgacatcttctcaaaataatattatctcacagccaagaaatagcgcttcgtttactgtgtttttctatcctgaaactaaatgggcttacgcttcatagtggctaagatactccacacacaactagtacccatagatcttttctcactgataggaaaaaaaaa

SEQ ID NO: 407953 - DNA, 466 bp, Homo sapiens
aggttagctgagtgattctggctcaaggtctcataaagttgcacacaggatatcagctagggctggagtcatctgaatgtttgactggactggaagatttacttccaagctcattcacgtaactattggccagaggcttcacttccttgccaggaggcctctctttagggctgctcacaatgtgacttcctccagagcaagtgatccaacagagagagcccaagacagaagctttatcttggaactcatatacagttaacttctgctctggtcttttggtcacatcagccaacgctgatccaatgtggaagcattttgaataccaagaggcaggagtcactgggggccatcttacaggctggcttccacaagtaccctgtatcagcagctgtctacccacctaaatactgaattaagatggtctcagccaggcacagtggctcacgcctgtaatcccagcacttta

SEQ ID NO: 407954 - DNA, 352 bp, Homo sapiens
aaggaatctagcccagggctcccactttcagttttagtcactaacccttttcaaaagcttcttttgcgagatatgacttttaaatcagacagctggagatcagttcctgcttagcggtcaagttgtgagccacctgcattgttgaccccacttaaagaggagacattgtgaggaatttgcccttttccaaaactcttgggggaaaacacaggaagtctggcagggagaaagccccagcaagtcacctttgaaaaatgtaaacaggattttcaagggtacaaagacccaggataataattttctttttaagttttgctttatttataataaaagatttgtatatatttataca

SEQ ID NO: 407955 - DNA, 361 bp, Homo sapiens
caccttcaaaatgcatccagaccccgccctttcttcgacacttggctgaccacaccctggtcctgtccacccttggctcctgtctggatgctcccagcagcctcctccctgggctcccttgccctgccccagtctgttccccacgcacagccgccaggggatcctgtaacacctgtgtttgtttcttcgggctgctgtaacaaattccaccaagttggtggcttaacacaacagaatgtatggccgggcgcagtggctcctgcctgtaatcccagcactttgggaggccgagacagtcgatcatttgaagttgcaccactgcactccagcctggataacagagcgagactccgtcttaaaa

SEQ ID NO: 407956 - DNA, 229 bp, Homo sapiens
cctttctcataaactttcagaatatttcacatttttcttctcccaaagatggtcctgtgttagtcacccttaaacttatctcacccctcttaaagaatttaagttcaacacgggcaagaaatatctatgctatcttcatactatctacatagaaggcttgcacatagtgtacattaatatactgttttaatttactgtcacgataatttacaaaccaatgtggaaaact

SEQ ID NO: 407957 - DNA, 951 bp, Homo sapiens
gctatcttaactgccatataagtgcattttaattttgcctttacttgtttagatcagtaactgctttgaaatttctcttcatttatgctctactaattttgtttatgcgtgagcaccaaaagtgttgactatttctacctcacagcagcacgggagcctcaagaaacagccattcttctaaagaaccatctcaaccactgttgggtcaggccaggccattccaggttgtccagttaaatgattgcactaggaaatttcctatgggattcttgctttatacccaggtatcgggagacaccaaggagcactgagcatgacaaccagacctggaaacgtactgagccctggaactttcattcctctagaaaatttgtcaccaagggaagtccccaaatgaccctggcactaatgtgggcttttacctgcatatctcttgttccttttgctggtctttgctgagttgtatgtctgttttgatgctgaagatgtgacttttgggaaaatctcctgggatcagctccaaactaaacagtgaaatatttgactactgtctgacagaagaaagacaaagtaaattcctgtccggagagtcagctatcttaaaaggttcatggcactacaaggtggcatctgaaaaaccatctctctagctaaagtccattcaccaatatctgttatgaatgactaaggctgtacttagtcatgatagccacatagggctatttaaatttaaataaatttctatatgttcataaatgctaagaaaaatgaaattcatagaggcagcatcttgtaactggatatactcatgaaggctgcatactagattaatagtattaatgcttactattcttctactgatttttactagattgagaatactaagggccccatgttggcttacttaggagagattagtagaaattttgttttcaccagtcattggaaaaa

SEQ ID NO: 407958 - DNA, 483 bp, Homo sapiens
ctaacatcatagcattttgttccacatgtattgactagaaaggagttctgaatctatctgagagtctgtggacattattaaattagatgaaaggttatagcttttttccaaatagaaatcgctttagtgtttttctgattacaaaacaatacatagctgggcatggtggtatgccccatagtctcagctactcaggagggtgaggcaagaggattgctttagcccagaagtttggggctctactgtgctatcattgtacctgtgctctgcactccagcctaggtaatgtagcaagaccctgtctcttaagacaaaacacacacacaaacaaaacaatacacattcactggaaatataaagaagaaaataaaaatcttctataacatcacttttaggttattgtgttaaactttgtaaggtatgtatttctatgtctaggctttttgttttcctgtatatatagtcatgtcaatactgctttat

SEQ ID NO: 407959 - DNA, 244 bp, Homo sapiens
cttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaag

SEQ ID NO: 407960 - DNA, 270 bp, Homo sapiens
ctaaatataagtattatttttcaaattattactagtgaaagtaagaaaaatatttattttccaaggcaaataaaaacaaattatttttaaatctttttttaatgaaggcattaaatgaaacatgtagtaggtaagagtctcaaatttcttaatgtacaggagggttattgtaataattttctagaagttggccacatctagaattaaaacattggtatatatacctacctggaaacagacaaaaatgaaataaaagatttctacatatac

SEQ ID NO: 407961 - DNA, 323 bp, Homo sapiens
aaattgggagtgtagcagaatgattggaggggttactagagactaattgctgcctccttccccccacctgctgcctccaatttctgattcacttggtctcggatgggacacaagaacttgtattctaaatccccaggcagataccaatactgcagatctggaaatcacactttgagaatgactgctctaacatattaaatgcattttatttatttattaaaacttttttgaattattttttatttcaataggtttctagggagcagatgatgtttggttacataaataagttctttagtggtgatttctgagattttggtgcg

SEQ ID NO: 407962 - DNA, 843 bp, Homo sapiens
  misc_feature (805)..(805): n is a, c, g, or t
aggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatcttngggtgggtgagcccaatttaaaagccagtgactacttt

SEQ ID NO: 407963 - DNA, 288 bp, Homo sapiens
aacaaattagatgagcatggtgatgggtgcctgtaatccctgctgcttgggaggcagaggcaggagaatcgcttgaatccgggaggcattcaatgttgcggtgagccaagacctcgccattgcactccagcctgggcaataagagcgaaactccgtctcaaacaacaacaacaacaacaacaacaacaaaagaacctggctagtctttgccttctctaaagttccccctaaaatgacgttactaatacctatcccacaggaccactgatggtgtttagagaatggatg

SEQ ID NO: 407964 - DNA, 696 bp, Homo sapiens
cttaaaactgcctgatatacttgggtgatattcttccaggaatgataaaatgagacagaaatggcctttgagtgttttcaggaagggaaaatggaaaatgaaagctggactaaaaggtgttacaaaagcaaactagttaatacttccaagaaatgaatatgctaagatattgtttgctgatcaacatttattaaacatttactgtgtaccactgatctaggctcttggccagatatgagcaacaaaaagaagatagtgtagtgcttgccttccaaaatctagcacagtcctagaaagaattcaggtttcactaaggctacttagggagagagttctctaggttctagaaattaaggcaggcacccacacaaagactcagttgcaaatgggtggaaagaatgatttttattaatcagcacaatatcttaaaaatcccagtgtagccttctttgataaaagacagagtacatgacttagaggcttaagaggggtcttctactacccattctggatttctgttttgagacttggaagttctaaagtccttgcagaggagattctgaggcccaccagtagcctaaaatctccaggcctgctcccctcactgcccccactcctgggtggaacacagacgtagaagatgctactcagctcagtggccctgcccaccatgcacctgaccctgtgaatgcctgt

SEQ ID NO: 407965 - DNA, 679 bp, Homo sapiens
gtagaaaaaagtgaggcattcaacagtcttagcagaaactaatttggggatagattgagaataataaattagtgaagctctaatagagtgcctttcttcaccaggtgaacttaagaatggagaatgaaggggggaggaggcacaagggactggctactccttatgggttctctttagttcttagaggtctttggatgtcaccaagctgagaacagctggaaggggaatttgaacatcttccaaacctctctattacttgaagttgagaagaaagtgattctgtctcacagtagcatatcaattcagtttaaactgcatttatactcaagtgtagtaattactagcccaatatttagtaattgtagattttaaaattctggccaaaactaaataatttaaaagttgaattgtttagcgcgagtgtggtggctcatgcctgtaatcccagcactttgggaggccaaggtgggcagatcgcttgaggtcaggagttgcagaccagcctggccaacatggtgaaaccccatctctatcaaaatacaaaaattggccgagtatggtggtgcctgcctgtaatcccagctaatcagtaagctaagcaggagaatcgcttgaacctgggaggcagaggttgcagtgagccaagatcgggccactgcactccagcaagaccctgtct

SEQ ID NO: 407966 - DNA, 623 bp, Homo sapiens
tagagttgtgaagattgattcttttttaatttaattttattttatttttgaggtagggtctctgtctgttgtccaggctggagtgcaatggcatgattatggctcactgcatcctatacctcctgggctcaagtgattctcccacctcagcctccccagtagctgggactacaggcacgtaacaccgtgcccggctaatttttttgtattttttgtagagacagggttttgtcatgttgcccaggctgtgcttgaactcctgggctcaagctatcctcctgccttggcttccaaagcattgtgaagactgaacaagatgtagacataaaatgctttgctgtgggtctggttcatggtgaactgtcagtacatgttaactactatggcaacactcctaaaagagttctaaagaagtgatacccaagtaacacttaattcttaatctgtgtgcctcagaagcaccagctgatcacatcagttcattgctatttctctgaaagcaccctccaaccccgccactctctgctgacatcatactttattttcattcatccaggttggacaacatcattgtcactatcaacatgactttgtcccttcttgctgtctcccttttatccctc

SEQ ID NO: 407967 - DNA, 867 bp, Homo sapiens
caaaatccagaattgcagatactgtgtactgtgttgcctgctgtttagagagaagacctttggtgattaaattgtgtgtgagtttaatttcaggagattatctttgtctgctttcttcagaaagaaactaaaaaccacatgatgtgaagggctgtcccgttcctaagttctccaccatgtgactgcctgcttcttttccattggtatctaccactgccccctaggaaggtttcttctgatctcctctgactataaggaccttaagggcgaggacactcccttgtctggcacatggggaggaggccgctttgtcaggacttaatggaaattgcttttaataaggacatcagtggaaattatgtctgggtttgttgtttgtttgaggagcgtaaaggggattgttatttattctagaaacagaataagagtctgaaccacatagaattacacaccgaagaggttttgttgtgactaccaactttgttgaggatatgaagtggctctacctagagtgctgtttgaaggactgtgggtctgagatgggctctgaagagtgccacgattgattaggtatgtctgccatgggcactggagatgggagaagtgctatgtgcaccttctgtttgccaagcttgccatagacctatctgaccatagtctatgctgatccatgtcagagtggagaggtctttttctctgggaagtctaatagactctgtggtaactattgaagtattatctaaacttaaacatatgctttgtgtttttccctgtaaccttaaatgagactgggcaaattgcattcttatcctaaaaccatgatgtggcacattttggtgttaataaaacacaacacacaaagtaaaa

SEQ ID NO: 407968 - DNA, 362 bp, Homo sapiens
ccaaaaagttagagcatattctgggatcttattgtttgtgtgagttgcgataggacagactatgctatagtaacaaatacatcccaaatgcttagtggatttacacaataaagctttatttcacaatcacacaaagtttcatatgaataaggtagctctcttccatctcagaacccatgacctccatggtgaatcatgtagcctccaagagaaagaaaaagaaggcacatcgggctgggtgcggtggctcactcctgtaagcccagcgttttgggaagctgaggcaagaggatcacttgaggccaagagtttgagaccagcctgggcaatgtgacgaaaccccatttctaccaaaaaaaaaa

SEQ ID NO: 407969 - DNA, 495 bp, Homo sapiens
gcgtggtcgcggccgaggtacgcgggctccatgtgacaagctctatgatgtgtcacatattatttgggcagcttcttttcaaatctatagaccaacaacttcagtcaaatgtgggactcaatgactgttgaaggcagtgagctagaatcaccagcaaagggctttcttaattaaaaataataaatgttgtacctcaaagtacggtcctttggcttcagagagatgacagttacagtaagagtgaactaaagttttgtcatttcgtgtaacacaaaagggctagacaattcttaaatcttcgcatctgaagggtttgtcaagggcttgcaaaatgagtcgaaatcacttaagagaaatttaatatcttaaactatgcattgccatggctctggtgtatgtctgaggcctgtttgaatactctgagcatttatggacaagaaaaggagctgtagatttcaccacctgcccccctcaacacctacccgtacgttgtat

SEQ ID NO: 407970 - DNA, 368 bp, Homo sapiens
catctagtctatacatcagtctctatcaggtcactatagcttctatcaggtcctgtgacttcttagcataaagcagtctggtgtctcccatcacccttaaaataaaatccacttacttctacagcctgcacggcctcccatgcattggcacctgcttccctctgcacctcttcccttaccattctctgccagctcactccagccacactggcattctttctagcctcgaacatgccatccaaccttcattttcttcccattccctctatctggaggcctacatagcacattagtattacccataaggtctctgcttaaaaatcacctctgcaagctgggggcagtggctcatgcctataatcccagca

SEQ ID NO: 407971 - DNA, 785 bp, Homo sapiens
ggggggaaggggagtgagagggtgagggctgcggcctcttcctccacttcaaacagataggcccaaaggactgaggaggtgccagtcctgcgctaggtgctggggacggagcagtgaataaaaccggaaaaggaccccgccctggtgtcagtgccattctagcagggggcccagacactggagataggtgggggtgaggggccaggggcattctgccaggaaggtggcaggaatgtgagtagagtgagttagcaaaggccccacagagagagcgtcgaccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcag

SEQ ID NO: 407972 - DNA, 414 bp, Homo sapiens
acgctctctctgtggggcagggagccggggtgggccctgaggtcgaggccctgcccctagctcctggagggggcctgtctgcggtccagggaagcccccaagttgaggttggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcag

SEQ ID NO: 407973 - DNA, 788 bp, Homo sapiens
tgtattgaccgtggcttatacgattacagaacaggctcctctagagggatctgaagcaccgcaggtcgtgagttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcag

SEQ ID NO: 407974 - DNA, 498 bp, Homo sapiens
  misc_feature (414)..(414): n is a, c, g, or t
  misc_feature (416)..(417): n is a, c, g, or t
  misc_feature (420)..(420): n is a, c, g, or t
  misc_feature (422)..(423): n is a, c, g, or t
  misc_feature (431)..(431): n is a, c, g, or t
  misc_feature (434)..(435): n is a, c, g, or t
  misc_feature (438)..(438): n is a, c, g, or t
  misc_feature (440)..(440): n is a, c, g, or t
ccacgctgttgtggaacaagcagctttaatttcaagtgcacgttccacaacgcagcgttcaacaacagcagcagcaagtggcacttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcgttccactncnntgngnncaacgagngtnnggngntcccgcattccgtgaatccttgttccctgattttaaacgatccgcccgtggaacccta

SEQ ID NO: 407975 - DNA, 1640 bp, Homo sapiens
  misc_feature (324)..(324): n is a, c, g, or t
ctggatccctggctggcccttcagggggcttcttccctggcaaccttgctcttcgaagcctcggacctgattcaaggcttttacaggaaaggcagctgcagctgcagcagcaacgtatgcagctggcccagaaactgcagcagcagcagcagcagcaacagcagcagcagcaccttctaggacaggtggcaatccagcagcaacagcagcagggtcctggagtacagacaaaccaagctctgggtcccaagccccagggccttatgcctcccagcagccaccaaggcctcctggtccagcagctgtcccctcaaccaccccagnggccccagggcatgctgggccctgcccaggtggctgtgttgcagcagcagcaccctggagctttgggcccccagggccctcacagacaggtgcttatgacccagtcccgggtgctcagttccccccagctggcacagcagggtcagggccttatgggacacaggctggtcacagcccagcagcagcagcagcaacaacagcaccaacagcaagggtccatggcagggctgtcccatcttcagcagagtctgatgtcacacagtgggcagcccaaactgagcgctcagcccatgggctctttacagcagcttcagcagcagcagcagctgcaacagcaacagcaacttcagcagcagcagcagcagcagctacaacagcaacagcaacttcagcagcaacagcttcaacagcagcaacagcagcagcagcttcaacaacagcagcagcaacagcttcaacagcagcaacagcagctacaacagcaacagcaacaacaacagcagcagtttcaacagcagcagcaacagcagcagatgggccttttaaaccagagtcgaactttactgtctcctcagcaacaacagcagcagcaagtggcacttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcag

SEQ ID NO: 407976 - DNA, 1185 bp, Homo sapiens
agatgagactttcatgcaagaaaataaatcctgcacatttgatgtactgctttaaacttaaagacctctttggacccgaaattgtaaggattctataaacctggagagtaatcctaagaaaaatcatcagaagaaaggaatttgtagaactaaaactgcaaacatccagaatcttgatggtgtgccaagccaaatgtcaactggaactcaaccaaaaactaaagtgctctctgataacagacccaaagaaagagtgggttcaaacaattctcctacctcagcctcccgagtagctgggattacaggtgtacgccattgtgtccggaattggtgggttcttggtctcactgacttcaagaatgaagccgtggaccctcgcgcatgtccctgaaatggagcgaaggatacaccaaaggaagagttgctacatcccatctctcctgggaaaggaacatgctgcagggagagagttgcgagagctcttcacccttctaccctgcagcaaaggaaaatgggtctcctcaaggaaggcatttccccacagcaaagctgcaagcaacatgaaataatgcaccatgactatgggttcttggcaaaggattcctggcctggtacagttagaaattgggctctattctcaagcaaagggttccaacaaaaaaataccgcagcaagcagaccgtggaatgtgcttctccactcttccatacggggtgatggcacagaatcagagttgaacatgggagggaagtggaagggataaaaatgtaatggaattgcagagttgttggcattcagatgtgtaggtggtgggtggcaagtcctgcttattgcctgtggttgtgagaggcaatggtgatgggtcttattacatagcagtaagagaaggagaaaaaaatatatatcttttcatttgtcaaagttatttatcgcaggattatttgtaattttagaaatttggagaaaaatattcaaaattgtgaaagctttaaaataaattatagtgtgtttatcccacagaattttagatattcattaaaaactacattttaaaagaaaatacattggaaaaatgctcacaatctactgcttagtgaaaaaaaatgaaaaacttggtataaaaattcttccaagtttttttaatatgcaaggaaaaaaataaaaaggaaaattttcaaatgttat

SEQ ID NO: 407977 - DNA, 465 bp, Homo sapiens
agatgagactttcatgcaagaaaataaatcctgcacatttgatgtactgctttaaacttaaagacctctttggacccgaaattgtaaggttaaccacctgggacggtaaactaccgaagtctgcttctgcttccaaaggagaaccgcagtgaaagtggtggacatgtcctaccatctgtaagctcaagatcctctagagaactgcaggattcagggtgctctactgacagtacctggggcagccggatcaggaaagagtttgtctagccacagttgtcccttgcagtcagctacagaagacccagtgctgtgagaaaatcagacagaagtatttccaagactttccatgtctgactaaccaaggtaaaatcaggaactaacctaacagcttctgcaccatggcagaagagtttgcagaaatgtacctgttttacttttcaatagattatattttaacacttttta

SEQ ID NO: 407978 - DNA, 869 bp, Homo sapiens
agatgagactttcatgcaagaaaataaatcctgcacatttgatgtactgctttaaacttaaagacctctttggacccgaaattgtaaggattctataaacctggagagtaatcctaagaaaaatcatcagaagaaaggaatttgtagaactaaaactgcaaacatccagaatcttgatggtgtgccaagccaaatgtcaactggaactcaaccaaaaactaaacctttactgatcacatgtttcctctgtcttgaatggatagcagcatcgactgttgcaataaattctccactccgcagacctgggcagcccacacctgtgccagaaattatgcaccagatggcaactgaaaatgactggatatctatgagaagaggatatttagagaaaatacacatttacaagtaaagcaagatttttaaatcaacaattcctgtactgaaatgttacatttgttaaataaataaatatatcttggactgcagaaatacagcaacttttttttttttgagatggagtcttgctgtgttgtccaggctggagtacagtggtgtgatcttggctcactgcaacctccaccccccaggttcaagcaattctcctgcctcagcctcccgagtagctgggattacaggcacactccaccatacctggctaattttttgtattttgagtagagaaggagttttgccatgttggccaggctagcctccaactcttggctagtcaagtcatccgcccacctcagcctcccaaagtgctgggattacaggcatgagccactgcatctggccaacatcagcttttaaacagaaaaaaaaaatttaggtgtcagctcaattatttctctttgaaagaatttaaatga

SEQ ID NO: 407979 - DNA, 234 bp, Homo sapiens
atctctagaaggaaaaatcaaaagagttgtcagagaagatttaggcacttgactcagagcatatcatgggtgctgaagaaataattcttgcttactcttttaataatgcaaacaaatgtaaaagtaaacagaaggtgacatgagtttaaagaatcatctctttcacaagtgagtttttgtattgttttgtttaaatactcaaggactgaatgaagtcagcataaggcacagaaa

SEQ ID NO: 407980 - DNA, 414 bp, Homo sapiens
ctatcttcaggcctgagaggcctctgcctccgctaacctcacttaaatgtgagaacaatacccgcagagataatgagctgtcagaatgtagaggacagacccatgggaacttcaaaattcccctctcaatccccattttatgttagaaaatcaagtaccgagaatgttaagttaaattatgtgaccaaaacaaggaaagaggctggtaaaactgcattttgcacaaaagtgttgattcaacatgaagtcaaataatatgttctaatgaaaccacacctctcacacacatatcctttctctcaaacctcggtgttactctggccaaaagtcttaggtttcttgaagtgtttgtggaagagtagatggagttttatttaacattatcaagaaatccaagctgcagacccacacata

SEQ ID NO: 407981 - DNA, 382 bp, Homo sapiens
tttttttttgggctagggtctcaactaggttgcccaggctggtctcgaacttctggccttaagcgatctcctcccacttcagcctcccaaagcactgggtttccaagcttcagccactgtgcgcagcctagactggattattcttcccaattaggcacctcctccctctagtaatattatatatcctcactctttgcaacatgacctttgcaagacctcctaccaggaagagtacattgactaatgtcattgactttgggcttggtcctgtgactcgctttggtaacagaaatggaagacattgcactgtaccactgttgagctaagactttaaggcataataatcaccaacccttttaagcttaaaccttccaccatagga

SEQ ID NO: 407982 - DNA, 380 bp, Homo sapiens
cttcttcaacaaaaggctgatcctgtctgcggcaagaaatacccaagatgagtgtggagcctcttacagtgccagagttaggaagtgccaaaagaaaaaaaatcacctaaaaccccacaacgatgaggctatgtcaaagggacgtaggagctaattaaaagaacatcctatgccaaaaatggaacaatttaagcaacaaaataacagagtattgaattataatccaaagtatgaaccaggcttgatggcacacacctgtaatcctagctacttggtaggctgaggcagaaggatccctggggcccgggaggatccctggagactaggagcaatatggcaaaactgcatctccaaaaacaacaacaacaacaaacaacaac

SEQ ID NO: 407983 - DNA, 754 bp, Homo sapiens
ctgatagcacggctcagttcaagtccagaacctcagaaccaaggaatctgacagtggtaactctcagtctgaggttgaaggcctaagatcctgcaggggcactggttcaagtctgaaggccagagaagctggagttctgatgtccaaggacatgacaagatggtgacccaaccccagaagagaacaaatttgctttcctctgtcttgtgttctatctgggtgctcagttgattggacagtgcctgtccaaattgggtgagagatctttcttagtccactgattcagtcctaagtctctttcagaaccaccctcataaagatacccagaaatgatactttgccagctatctgttcagccctttttacccagtcaagttgccaccaaaaattaaccatcacagggtctctccggccgctgcagtcagatgatagctggggtcaggctctcttaaagccttctccattcacatgtgcctgcccggggaaaactcaaacagctctgggctgaaacggctggaaaaccttggcatgtctatgtctctctctctctctctctctctctctctctctctctcagcttttcatttggtctttcaacatcagggcctcagggcaaccaaacttcttacattgtagccaaagacgccagaatgattatcccaagaaaaagtcactgatgctgggtgtggtggctcaggcctggaatcccagcactttaagaggctaaggtgagaggacaccaatttagcaggaa

SEQ ID NO: 407984 - DNA, 984 bp, Homo sapiens
ttttatcattaataattcaatagagataatgagaaaggattgtgtgagtgcccatctttgttccaggccccagaaatacaatggtaatgaaagacagatgtggtctctgtcgtcacagaacttgcactttaataggaaggtgtgtaaatcaaaccaccatacaaacaaatgaaagattgcaactgtggtgttaagaaagaaaagcatatagtgttctgaaatctgtaactggcatatttgacctggggatatcaagaaagaattccccaaggaagtaaacctaaggtgagatctgaatgatctcatctgaaatcacatgaaataactagttgaaaagagtgggaaattgtactccaagcagtgactacatttgtaggggagaaagcattgtgtgccagttatcaagttatagtgtctcttggctccagatctactcttcttgccctactttgtgatactggagctggaccctgtaagcaattctcttttgccagctagtagaatgttaacttttgatgtcagcagatggcaataaagtgaccctgcaaggccataagaacaggagtatatctctctttggggttctggatctctattattattaattattattattcacaggaacccagcagccattcagaggagctccaacctacatcctcgtgccattccccacctcccgccactgtcagtggctttgagcagctccaatccatctacaccctctggcaatggcagcctcttaacagaagagctcagtctgtgccctttgacaagtttcttcaccaccacaaggctgcacgttcctctggtagccacacaccttcttcgatcaggtcagaatctcagtcttggcttgggggcctcccctaggccttagttcctttattgtctcattttcttcagtacagatatagtaactgctctcatgctaaatgtggacaccttatggtcctcttttaccccttctagtagttagtaacc

SEQ ID NO: 407985 - DNA, 323 bp, Homo sapiens
cgtggtgtatgttgtgctgtttcatgaacacagattgcttctacaactaaaaattagaaacaaattatataacataatctggacataagaacaaagtataacaaaggaacagcccactaaacatgcttctctgcaagaacccacagagtgaaatcaaagagtcagagcccaacttccaaagtagaaaacaaaaagtcctcttacatggtcctggatatttacatactctattcaaatgtagaggctatatttatagaactgtcccaatatcaggtttctatgaatcaggttcttctagcacatgaatgaagacctcactgcca

SEQ ID NO: 407986 - DNA, 496 bp, Homo sapiens
agttacttttccaaaggtaaaataaaaaatttaaaaatgttttatgttcaacgttcagtacttaaaggagatcctgagttttagctagaaatgttttcagttttatgtaagttataatcagaaagattaaaaatgtacagtgaaattgtgttttaattcagttcatactcttggtgacagtttgtttttgtggactatttaggatactaaaattgaaatagataggcttccggccaagtgcagcagctcatgcccacaatctcagcactttgggaagtctaggtgggaggattgcttgagaccaacctgggcaacataacaagaccctgtctctacaagaaaataaaaataaatctagctgggttcagtgttgtgtgtagcctcagctacttgggaggctaagatgggaggattgcttgagcccaggaggtcgaagctgcagtgagccttgctcacactctgggtgacaaagcgagaccctggctcaaaaaaaaaa

SEQ ID NO: 407987 - DNA, 326 bp, Homo sapiens
gatccctcacatgcacagttcacaacagggttcacattcgtatgacaatctaatgctgccactgatctgacaggaggcagagctcaggccgtaatgctctctcgctgggcagccctcttcctagcaggccgtggactgatacaggtctgcggcccagggtatggggacccttgttctaaaggacatccacctaaacagggatcctcaaccaacagatgggtatcagaatcacctgaaaggcattttcaaactcattttgaaggctgtagtgaactactactattactggaaatgtaacagaggggttctgggatagcaaaggtgaa

SEQ ID NO: 407988 - DNA, 369 bp, Homo sapiens
ttcaaactttgtgcccattttcttattgagttgattactttactattgagttaaaatagttctttacatattctggatataagtcctctgtctgatgtatgtgtttggacataatttctcctagtctatggcttctttttcattttcctactgctgtctttcaatgaacaaagcaaaaacttttaattttgataaagtccagtttaccaattttttcttttatggtttttactttttgtgttctatcacaaatatttttctcctatgttttattccagaaattttatagttttgggttttacatttaggtctatgaaccattttagataatttttgtgtatggtatgaaccgagggtcaattttttttc

SEQ ID NO: 407989 - DNA, 1153 bp, Homo sapiens
gtgcagtggcgcaatcttggctcaccgcaacctccacttcccaggttcaagcaattctgcctcagcctcccgagtagctgggattacaggcatgcgccaccacgcctggctaattttgtatttttagtagagacggggtttctccatgttggtcaggctggtctcgaactcccaacgtcaggtgatcctcccgcctcagtctcccaaagtgctgggattacaggtgtgagccaccatgcctggtctagggaattgacttctttttgaccttctgcactcccttccccaaaaggattgtggcttctgttgaccattgacctcagcagaagttgataaggcaggaggtttccagtcctcctggaaaaccaactgctgagcatgagttgtccttggctgtctctgggcctcgcacccatgggaagttttgaggtagggcccttgctgtttacaacttctgagagagtagtgatgggaccccaaagtaagcttgtatcagagggcagtaatgaccttcccatatccccatcctgtggtcacctgggatttgggttccctggggcggaagtgggaaataggagcccagggaaggacatctgaagcacccacagtttaaatagcgactcttcttggttagccagggctgtgctcatgttgggccctacccaggtcagtggccttttcactctcaaagatcgggggtgacgaagcagcattcttaaacagtgttaggctgacagatttttccagttgaagaagctgaagtatctgccttttgagggtgactctagattacaagagagactatcagatccaatcagcttttgaaaaatcaggaatgtgcttaaaatgccagtgagtggttgtgaagatcaggtttatttcccaggataggcagtctttctttccctccttttccagttctcttttcctacctgtccttccataagcctggtctctagtgccgaggaccttggagaagagagggcccctagctaagctggagccagaaagaaccttcatggtgagtgtggtttcccaaacttgggaaatgaacctagggtgaggggcaggggagtacgtcagtgggaagtgaaatttgacaaatacactgataccagattgaccagatggtaagtagtgaatgccacgatta

SEQ ID NO: 407990 - DNA, 242 bp, Homo sapiens
tgatggggttttggggttgaagggcatctgtgatgggcattgagccacgctggccttcgccgggtgctgtctcagctgacgccccctgaccccatgtgcaaccctcaggccgcaggaacccgggcatccagggctggacgctctaggtgacagaaatttgaaatgcaagaaagacccagacaccgaaggcaggggctgccccatgagatcgctcctcatggcactggaaacagcgagtggaa

SEQ ID NO: 407991 - DNA, 468 bp, Homo sapiens
taagtttggtgagacaggctaaattgaattcaaaatccatcagtgactcatgaccatcagttagaaacattctggattgggagcctttggaatcacaggagttgagagactgccagctcacttcattgtcatttaattgtgggtcctcaaaggggaatgttccaaatgtcatgtcttcccagctttgtgtgggtggtgggaaaatgaagaggggtaatagggagagaattaatgtcaggagaataagacagaaaaggcctacaattctgtagtttctcctaagactggcttcaggattcctttgagtttaatatttctgttatgtttttatcctgagatatttaaatttccagaacattcaaggtcaatgataagactattagaaagatttttatttaaacataaactcaaaagcactcaaggataaagaagaaacctatgagaactctgagtaggtaacctacaatt

SEQ ID NO: 407992 - DNA, 371 bp, Homo sapiens
taagagatgagggtctcgttttgttgccagcttcaagctggatgacttgaattggctcaagccatcctcctgcctcagcttcctaagtaactggagctataggcacacaccactgggcctggctgggaatctgaacttttgaatttcttgacgtttgaattctcaaccagaaccattgcattaaggacatttttggaaaacgggacttttacattttaacaggttatcgaatggtggaacatgcaggcctagctgtattagcagaaacacaaatgcgtttgaagtatagctacgtgaaattagacaattcatttccacttagtgcaaatagcaaagccccatttctgagagagagcctatttgccaaaaaa

SEQ ID NO: 407993 - DNA, 901 bp, Homo sapiens
ttctcttcttataaggacaccagtcatattgggttaggacccacccataaggcctcgtttaacttaattaccctttaacggccctatttacaaatacagtcatactttgaagtactgggggtgtggattccaacacatgagttttgaggggatgcaattcagcccatagcatgtggtaatgtagaatgtatgtacagtcaataaaggaaagaatataatatttttaattatatttagaaaaaatataactttatgtatcaaggaacatgataagcaaagtaaaaagaaaaataacaaactaggaaaacatatttccattgcacatcacggacagtgttacctgttctaatatacagtgtcccaaaacagggaagagcaaccacatagaaagatgtggttgagagaaatgaacatagttcggagaaaaagaaaagcatatgacttatagccatataaaaagatgcacaacttcattgattgtaagagaaatgcaaattaaatacaacgaataccatttctcaactattagatgggtaaatggttcaagtgtgacaatgtacttagttggagaagctgaagggcatttttatacattgttgatgtgattgcaaaatggttttacaaaacaccatatgcatttattctttgacaaaacaactccacttctagaaatttattccactggcaaaattacagaaaggtgtgtggacatggctttcattggatatctactggagtagcataagactagaaccaactccaaattcccagagtaagaagctagttgaataaactatgatactccacacaatatggttctatgcagttgttaaaggaatgaggaatatctttatgatatattgcccactggaataaagcaatgtagagtaaagtgtataca

SEQ ID NO: 407994 - DNA, 2054 bp, Homo sapiens
  misc_feature (1171)..(1171): n is a, c, g, or t
atgagtgaagaatggtttgctttgggaatattttcttagttcttcaaggacatgatgtggaagtcttgacttgagtaacttcaatagcactaacaacaggaattgaaaaaaacttagaattttaaagctgagaaagagttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgntacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatggggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 407995 - DNA, 855 bp, Homo sapiens
  misc_feature (733)..(733): n is a, c, g, or t
  misc_feature (744)..(744): n is a, c, g, or t
  misc_feature (754)..(754): n is a, c, g, or t
  misc_feature (767)..(767): n is a, c, g, or t
  misc_feature (775)..(775): n is a, c, g, or t
  misc_feature (779)..(779): n is a, c, g, or t
  misc_feature (783)..(783): n is a, c, g, or t
  misc_feature (797)..(797): n is a, c, g, or t
  misc_feature (810)..(810): n is a, c, g, or t
  misc_feature (820)..(820): n is a, c, g, or t
  misc_feature (839)..(839): n is a, c, g, or t
cgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacaancattgagcagntttgctgtanttcaaaaaactgncccccggngggntaanggattggggaaacnccaggaagggggnaaatcccaanccagggcccaaaggggggnacaaatgggccctttg

SEQ ID NO: 407996 - DNA, 620 bp, Homo sapiens
tcactatctgtttgtgttttaatagctcagctttcacagctgacaggcataagaaaagaaaacttttggaaaactcaacactaaacagcaagttattaaaagtaaatgtaagtaattaaaatttattcaaatataagagttagttgagatttaatcactgttttgttacaactctaacatgtaatgttacctgttacagacttttataaatgtgtgtcttggatttggagtattttacacaatgtttgccacctgtactgtcgattgttgccgtgaccccagtgagtccatctgtcagcaccttcttcccatcagcgttactgctgtgctcctcttccctttttagcatggtgaaaaaatggctcttcagtaagattgtcatcacatggagagggtagaggtcatcgagatactgatgtcattgaccactgctccttcttccttgttctgtagcctgagaacagtggcccggagagctgcctgtatgacctcgccgctgtggtggtgcaccatggttccgggtgagtacaacagccagcttctggtgggtgggaatacctggtggccagcccaatgacctgcagttttgtaccactcttgctagttcttctcaactcgtg

SEQ ID NO: 407997 - DNA, 2546 bp, Homo sapiens
  misc_feature (1663)..(1663): n is a, c, g, or t
cgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgccttcaaatgtttatctggtgtgactgtattatgccctcagagagtactgtatgttgcccaggctggcctcgaactctaggctcaagtgattcttctgcctcagcctcccaagtagctgggactacagatgcaatcaccaccacacttggcagtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgntacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatggggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 407998 - DNA, 2236 bp, Homo sapiens
  misc_feature (1353)..(1353): n is a, c, g, or t
gggataacaatgtgtctttggtagaagagtttagaaagacactctgtgctttatggcaaggcagccagactgcatttagcccagagtccttattttatgttgtttggaagattatgccaaactttagtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgntacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatggggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 407999 - DNA, 1857 bp, Homo sapiens
  misc_feature (974)..(974): n is a, c, g, or t
tcactatctgtttgtgttttaatagctcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgntacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatggggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 408000 - DNA, 1156 bp, Homo sapiens
cgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatgtaagtaattaaaatttattcaaatataagagttagttgagatttaatcactgttttgttacaactctaacatgtaatgttacctgttacagacttttataaatgtgtgtcttggatttggagtattttacacaatgtttgccacctgtactgtcgattgttgccgtgaccccagtgagtccatctgtcagcaccttcttcccatcagcgttactgctgtgctcctcttccctttttagcatggtgaaaaaatggctcttcagtaagattgtcatcacatggagagggtagaggtcatcgagatactgatgtcattgaccactgctccttcttccttgttctgtagcctgagaacagtggcccggagagctgcctgtatgacctcgccgctgtggtggtgcaccatggttccgggtgagtacaacagccagcttctggtgggtgggaatacctggtggccagcccaatgacctgcagttttgtaccactcttgctagttcttctcaactcgtg

SEQ ID NO: 408001 - DNA, 2393 bp, Homo sapiens
  misc_feature (1510)..(1510): n is a, c, g, or t
cgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgntacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatggggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 408002 - DNA, 732 bp, Homo sapiens
  misc_feature (713)..(713): n is a, c, g, or t
cgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaagttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctntggtagaagagtttacgaa

SEQ ID NO: 408003 - DNA, 2509 bp, Homo sapiens
  misc_feature (1626)..(1626): n is a, c, g, or t
cgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggatttggggaacctgaaaatactttgtacagataacttttttttaaaaaagaagaaaagtagaagcacttaaattctgcagttgaagagacagattcctctcctagattttgagaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgntacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatggggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 408004 - DNA, 2116 bp, Homo sapiens
  misc_feature (1233)..(1233): n is a, c, g, or t
gttcattgcctacgtggcttttaaaaaagactcttgaaaaacattccattgtgaattccaggtcctctttaaacttaccaccagcagtaactgcctgcagagccatgtgatcatcttggcaacagccagaccttttagtgatttcattactgtggtttcctcaagctctttacacacattgattaatattttccttgcagttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgntacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatggggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 408005 - DNA, 1922 bp, Homo sapiens
  misc_feature (1039)..(1039): n is a, c, g, or t
tttgttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatctcgataaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgntacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatggggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatac

SEQ ID NO: 408006 - DNA, 1198 bp, Homo sapiens
ttttcagggtgacctaccctgtgagtgcctccaagtggaagccaagttagtgctcagagcaacaggggcactgatgaaactgggaaaagcaccttggcaaggacggagcccgagctcagtaatgggaaggctgtccagccctgctgccggtatccaggaaggtaaactctttcctaggagacttcaaaatcagcataaatgtccagttatctgtagtgtcgcggttatacccatccaaccactgattcaacaaccagcctccagtggggaatgcgggtcttgttcttgcatgggttggaggctcctggtatctctaactgacatccaacaaccagtaactcaagtcactaagagggtagggtggggaggaatgccaggccagagctggtgtttgcattatgtgctatgcactcacaaaacattgttttagttttagagatactgaataattcttcccaaaaaactctgcattcggtgactatcctgttcctggtcctgagtttgatcacgtcgctgctgagctctgggtttaccttctacaacagcatcagcaacccttaccagacattcctggggccgacgggggtgtacacctggaacgggctcggtgcatccttcgtttttgtgaccatgatactgtttgtggcgaacacgcagtccaaccaactctccgaagagttgttccaaatgctttacccggcaaccaccagtaaaggaacgacccacagttacggatactcgttctggctcatactgctcgtcattcttctaaatatagtcactgtaaccatcatcattttctaccagaaggccagataccagcggaagcaggagcagagaaagccaatggaatatgctccaagggacggaattttattctgaattctctttcatctcattttggcgttgcatctattgtacatcagccctgagtagtaactggttagcttctctggacaattcagcatggtaacgtgactgtcatctgtgacagcatttgtgtttcatgacactgtgttcttcattgatgctgtactcctgaaaatttttcccacaaggttggggaaatgaatgggaaatgtcgctggtctgtgtggtattcaaagcagtagtatcatgatgagcgtaacgacccttctgacctggtctcacgatctgaaataataaaaggctgtgtcatgtttcttttcaaaaagta

SEQ ID NO: 408007 - DNA, 1112 bp, Homo sapiens
tcagggcagcccagtctccgtacccagttcttaggaccctgggacctctccccaggagctgagcttgtatctcacagtcccaggtgctccaggcccactgcccacccagggtctttttaaggcggcttcttccatctgtgatgccctgtccttcctcagctcttcccagacctccttatacagcttctctctgaactgtcctagtcaatcattcattcagcacactactgcattcaccacctaggaagtgcgctgtttggtagacaagttacacaactgcttctgaaagcgtttgagtcagcacattcactattggtcatacacagccctgcacaatctttagtgttctatgcctagacatctagtttgtgtcttacaattttgtaccttctccctagtgcttaaaagagtgtaaactcctgtgtagatatgcaatacattcccatatatatgtgttccataaagataagtgacattaaaaactgtatcaccatgccatgcatgaaactccatcttcctttcagcatccttcgtttttgtgaccatgatactgtttgtggcgaacacgcagtccaaccaactctccgaagagttgttccaaatgctttacccggcaaccaccagtaaaggaacgacccacagttacggatactcgttctggctcatactgctcgtcattcttctaaatatagtcactgtaaccatcatcattttctaccagaaggccagataccagcggaagcaggagcagagaaagccaatggaatatgctccaagggacggaattttattctgaattctctttcatctcattttggcgttgcatctattgtacatcagccctgagtagtaactggttagcttctctggacaattcagcatggtaacgtgactgtcatctgtgacagcatttgtgtttcatgacactgtgttcttcattgatgctgtactcctgaaaatttttcccacaaggttggggaaatgaatgggaaatgtcgctggtctgtgtggtattcaaagcagtagtatcatgatgagcgtaacgacccttctgacctggtctcacgatctgaaataataaaaggctgtgtcatgtttcttttcaaaaagta

SEQ ID NO: 408008 - DNA, 1161 bp, Homo sapiens
caatgtccattagcataacccttcctcaggaagagtgagattttatatttgacaataaagtgttagactccatttctaaataccagacttcaaaagataaggttcaaaagtgttataagaagatattcctttttttgtcctagagaacttattttcctgtgaaaatgcctaccacaaagaagacattgatgttcttatcaagctttttcaccagccttgggtccttcattgtaatttgctctattcttgggacacaagcatggatcaccagtacaattgctgttagagactctgcttcaaatgggagcattttcatcacttacggactttttcgtggggagagtagtgaagaattgagtcacggacttgcagaaccaaagaaaaagtttgcagttttagagatactgaataattcttcccaaaaaactctgcattcggtgactatcctgttcctggtcctgagtttgatcacgtcgctgctgagctctgggtttaccttctacaacagcatcagcaacccttaccagacattcctggggccgacgggggtgtacacctggaacgggctcggtgcatccttcgtttttgtgaccatgatactgtttgtggcgaacacgcagtccaaccaactctccgaagagttgttccaaatgctttacccggcaaccaccagtaaaggaacgacccacagttacggatactcgttctggctcatactgctcgtcattcttctaaatatagtcactgtaaccatcatcattttctaccagaaggccagataccagcggaagcaggagcagagaaagccaatggaatatgctccaagggacggaattttattctgaattctctttcatctcattttggcgttgcatctattgtacatcagccctgagtagtaactggttagcttctctggacaattcagcatggtaacgtgactgtcatctgtgacagcatttgtgtttcatgacactgtgttcttcattgatgctgtactcctgaaaatttttcccacaaggttggggaaatgaatgggaaatgtcgctggtctgtgtggtattcaaagcagtagtatcatgatgagcgtaacgacccttctgacctggtctcacgatctgaaataataaaaggctgtgtcatgtttcttttcaaaaagta

SEQ ID NO: 408009 - DNA, 399 bp, Homo sapiens
taagtactgtagaacagcataatcttgtccatcagcctcagtaaacatcatctgagatgacagaaattaatgatgtcataggctgactaatgtggagcagcagaggacatttcaggattcttttgaacttcacatttacttataaatggctgcacaacattccccagcagaacctgctctgccagaatgggtggtaactgctagagggtgcagatagcctggcatttctctggcacacccctttttgggttgatgatagaagagctgcttaggtgttccatgaacacagttcccttgattggtgccctggatggattcgcctcccgccagttatgctcagtagccactctaggctgttcctgtattggaaagaatgatggtcccagagtttttaaagag

SEQ ID NO: 408010 - DNA, 1679 bp, Homo sapiens
gacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaatttt

SEQ ID NO: 408011 - DNA, 1955 bp, Homo sapiens
acaccctctgccgactccaagacgctgcctcttcctgcgggcaagggcgcggtctggtactcgtgcgtcttttatcgcctcagtttccctccgccgactagcgcgcggggcccggttctccatcgcgcgcacggcagcctagcgcaatgaggcgggcagcactgcgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgataggcatgagccactgcacccggccggtggaaagcatttttaacaaaaaatttttaggccaggcacagtggtggctcatgcctgtaatcccagcactttgggagactgagatgggaggatcgcttgagaccagcctggggaacatagtgagaccctttctctacaaaaagttaaaaaattatctgagcatggtggtgtgcacctgtagtcccagttaggaggctgaggtgagtggattgcttgagtccgggagtttgagtctgcagtgagctatgatcatgccactgcactccagtctgggtgacagcaagac

SEQ ID NO: 408012 - DNA, 487 bp, Homo sapiens
gagtgcaagcgttgaaagagtgatagcagatctagagtacaccctcgcgaacgtgttatcctcaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggataacacgttcgcgagggggatcc

SEQ ID NO: 408013 - DNA, 407 bp, Homo sapiens
ttcatataaattatatttggttttgatcagttagttattgaaggactgaggattgctatagttaatttcctataactggaatgtatattttgaagtgctaggaaaaacacataaactcaacacagtatttgaaatactacagatttatcctttagttttgaattattgctggttctctaattgattttccctttattcatatagcatgttcatctatacatgtgaatcatggtgtgtgtggtaattagtatcagcttttcttttaagagcttaagttttgtaagcactaatatacgcttgcacttttgggcagtggcattaactaaaattgcattctttgccttagcttgatgtaagtctttgcttcatttttctggcttaaacttttctaacaaccaggagactat

SEQ ID NO: 408014 - DNA, 2828 bp, Homo sapiens
gacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgataggctgggcgtggtggctcatgcctataatcccagcactttgggaggctgaggcgggcggatcatgaagtcaggagatcaagaccatcctggccaacatggtgaaaccctgtctctactaaaaatacagaaaattagccgtggtggcatgtgcctgtagtcccagctacttgggaggctgaggcaggagaattgcttgaacccgggaggtggaggttgcagtgagctgagattgcaccattgcactccagcctgggcgacagagagagactgtctcaaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggatatatctgatttaaaaaataggaaccacaataataatagctgcttatgcttatggagcattgccatgtgctagataggcaccatcctcagcccttggcaggtctgagctcctttatttcttccaatcaacactatgaggcaggttctgtaaccccccttagggttaggccactcgggaaactgaagcacagagagtttaagtaacttcctggaggtccgacgcgtaacatgtggaggtgctgggattcaaaaccaggcaatgtgggtcccgggcactcttgaccagtgcctgtacttcttccaaggaatagagcaagggaggtcataccgaatatcacagtgtcacctaggaagcccaagggaggtattcccgttaatctgcagccaagg

SEQ ID NO: 408015 - DNA, 2646 bp, Homo sapiens
gacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgataggctgggcgtggtggctcatgcctataatcccagcactttgggaggctgaggcgggcggatcatgaagtcaggagatcaagaccatcctggccaacatggtgaaaccctgtctctactaaaaatacagaaaattagccgtggtggcatgtgcctgtagtcccagctacttgggaggctgaggcaggagaattgcttgaacccgggaggtggaggttgcagtgagctgagattgcaccattgcactccagcctgggcgacagagagagactgtctcaaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggatatatctgatttaaaaaataggaaccacaataataatagctgcttatgcttatggagcattgccatgtgctagataggcaccatcctcagcccttggcaggtctgagctcctttatttcttccaatcaacactatgaggcaggttctgtaaccccccttagggttaggccactcgggatacacgttcgcgagggtaccggctcgatcg

SEQ ID NO: 408016 - DNA, 2461 bp, Homo sapiens
gacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgataggctgggcgtggtggctcatgcctataatcccagcactttgggaggctgaggcgggcggatcatgaagtcaggagatcaagaccatcctggccaacatggtgaaaccctgtctctactaaaaatacagaaaattagccgtggtggcatgtgcctgtagtcccagctacttgggaggctgaggcaggagaattgcttgaacccgggaggtggaggttgcagtgagctgagattgcaccattgcactccagcctgggcgacagagagagactgtctcaaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggataacacgttcgcgagggggatcc

SEQ ID NO: 408017 - DNA, 922 bp, Homo sapiens
gacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaatgtacattaatttgtttataataaaataaatttgaaaagcacattaattacgctg

SEQ ID NO: 408018 - DNA, 848 bp, Homo sapiens
gacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccaggccggcatttgtaaatccactcatccctgaaagcccagaggaagaggagctctttagacaaggggaatgtacattaatttgtttataataaaataaatttgaaaagcacattaattacgctg

SEQ ID NO: 408019 - DNA, 168 bp, Homo sapiens
atttagagagttgtgcatccatcaccacagtcaattttagaacattttcatcaccctgaagtgtgttatttatttttaaagggagaccaacatgatttgcatttaattcactgtttgctttatttcacagatttggcaggattcttgaggatcttgacagcttgggag

SEQ ID NO: 408020 - DNA, 2779 bp, Homo sapiens
  misc_feature (290)..(290): n is a, c, g, or t
aagagcagtaacacaaacagggctgaaacacgccctcctcccgtccccacacccccgcgacttgccatgttgcgggtgatgtgaaggagagaagtgctgtggcccttcagggagcacagacctaggggctccctgagccagggctgtgacaccctctttggggctctgcggtttctggtatcttcaaacttccgggcaccactgcattccccttgtccagacacaggtgcccacagcagaagccgcttgtggttcatcagatccagctgcagacttgcatagaaccggcncctttgccggcgcctggagctgcctgcccagctgcagcagctggtgtgtccggctctgcgcagtggccagaccctgcgttcgctcgcctgcacacccctcgctgttccgtgcctggctcaccctcggcaggcgtggaatcctggctggtagcatgagctgagcacagcctgccaggccacgtcagtggaacaagtctggcgggcctgatcaaaactcaggcaaaggcaccactggtcacagagctttctagctggaaaagcaacacctgaaggatcccgtgacacaatcaacctgctaggagatccctgccaccctgagaggctgcaggaagctgcctccatccaggcctcttcacagaaggagaattgcagagaccgtaggatttttctactcacaggaacagatggtgtccggtcaggaaggtaaaatgcttcaagaaaagtgcaatagggattataatactgatgatctgagactctgataatgactctgagatgattcccaattctatgatgaatcatctcagaatgactccgagatgatgattcctgattctacgatgattgaggcagagctcactggttggtgaatctagttggtagagctgaggcaccgcaataccatcatttctttctgaggaaatctaaagatgaaagaattcatcactaaaactgtactacgagaaatgctaaaggaagttgttcaaactgatggaaaattataccagatggacacttgaatttgcccaaaggaatgaagagcaccagaaatggcaaatgtgtggtcttactgtatcttcatgtcagtgtcatatcaaggacaagacagcagaaatggtccactccagttgcagatagtaaagaccctgtagctccagcatcagctcacctttctggttttgaatttcatgcttattaccatcctgtcatcacctactgtttccatggtagacgggactaagagatgggctttgtgccttgggcaaagggcagcttactcctggaagaggactgactcaaggaccccagaaccccaagaaacagggaatcttccacattcatgaagttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaatttt

SEQ ID NO: 408021 - DNA, 1706 bp, Homo sapiens
gacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaatttt

SEQ ID NO: 408022 - DNA, 2699 bp, Homo sapiens
gacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagcatgttcatctatacatgtgaatcatgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattgataggctgggcgtggtggctcatgcctataatcccagcactttgggaggctgaggcgggcggatcatgaagtcaggagatcaagaccatcctggccaacatggtgaaaccctgtctctactaaaaatacagaaaattagccgtggtggcatgtgcctgtagtcccagctacttgggaggctgaggcaggagaattgcttgaacccgggaggtggaggttgcagtgagctgagattgcaccattgcactccagcctgggcgacagagagagactgtctcaaattaattaattaattaattaattgaggataccattggatgcattcttttcttacacatattgcaactgtcagtatacaaggtttcctgccagggtatttggatgacgttctttaaacctaaccacttgctctgtgctgtctaaatcccatcagccgtacatgattcctttgcttccctctatttcccagcttttgttgtcagagggtagatgaaaagttggggcgaagggatttaacaaaagttactgcatccgtaaagatttgtgggaagatttaggtctgaaaccataccattagaaggtgtttagagatgatctagataaggaaatacaggaccatttggtcattctttcattcaccagacagctatttagcacattctgctagtggctccgcaggatatatctgatttaaaaaataggaaccacaataataatagctgcttatgcttatggagcattgccatgtgctagataggcaccatcctcagcccttggcaggtctgagctcctttatttcttccaatcaacactatgaggcaggttctgtaaccccccttagggttaggccactcgggaaactgaagcacagagagtttaagtaacttcctggaggtccgacccgacaaatttaagtgatcaccgacgaatttaagtgatca

SEQ ID NO: 408023 - DNA, 784 bp, Homo sapiens
caaccaataaagaattgcaagcactggctttatccttccaaggcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaatttt

SEQ ID NO: 408024 - DNA, 1029 bp, Homo sapiens
gcatctcaatgggataactgcaggtcagggctctggatcaggatgatatcaagtgatctcacactgaaccaatataatttccatgtggaaccaaagactcactgggagttttatgtgtcctctgcagttttctcttggatacgtgtataattttcagtgagattttgaaaggcatcccaggtcagaataccgtgtgctgtagtgcgaccgtcctgatcattgctccttattctcccttgttccagtgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcgatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaatttt

SEQ ID NO: 408025 - DNA, 564 bp, Homo sapiens
acaccctctgccgactccaagacgctgcctcttcctgcgggcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggaccccagaaccccaagaaacagggaatcttccacattcatgaagatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaatgtacattaatttgtttataataaaataaatttgaaaagcacattaattacgctg

SEQ ID NO: 408026 - DNA, 2852 bp, Homo sapiens
  misc_feature (1574)..(1574): n is a, c, g, or t
  misc_feature (1678)..(1678): n is a, c, g, or t
  misc_feature (1734)..(1734): n is a, c, g, or t
  misc_feature (1822)..(1822): n is a, c, g, or t
  misc_feature (2027)..(2027): n is a, c, g, or t
  misc_feature (2291)..(2291): n is a, c, g, or t
  misc_feature (2402)..(2402): n is a, c, g, or t
  misc_feature (2852)..(2852): n is a, c, g, or t
gtaccaccatgccaggttaattttttgtatttttagtagagacgggctttcaccatgttagccaggatggtctccatctcctgacctcgtgatctgcctgcctcagcctcccaaagtgctgggattacagacgtgagcgactgcgcccggcatctttttatatttttaaaaggtcacatgtatgtcctttcctgtgaactgtttatattctttgccaaagtgctgggattacagacatgagccactgcacctggccttacctcttctttttttctttaatcacctgtggaggcttttagattgtgccttttgctgtcaagtctactactactcttccatcggcttgtcatacaaccatttgttgaaatttcttttgtattttgtttgccttttgggctctacactttttaaaaatttatttagctgtcaaagagatgacatactgtgtatggttaattttccatgtattctggagttctaatatattttcatggtttttaaatgtttagttctttaatcaagttggaatttttaaaatatatatgaagtaggatgctaatttaaaacttttcctccaaatggatatccatccagttgtctcaacatcatgtatagaaaaaacaaattgaaaatgctatcttatcatattatttactaaatttacatgcatatacatatacatacataacatatatctgagtttgagtctgaattcactactgtttcaattgctgtagttggtcaattctagtatgacagagttttaattgctacagttttggaatgattatggggttacttttgagacagggtctggctatcttgcccagactggtctcaaacttaccggctcaagcaatcctcccatctcagcctcttaaagtgttgggattataggtatgaaccactgcacctggccctggattgcattttgactgtggccatagaagtttccactcagatcttcaagagaacctactctggggactacaagtgactgacagccagctgccacccctttggaactaccatgcattcatgtcaatgccacatatctctggagtcgcccccagctagtggctgagcacagcaggagtactaaacttgttctttcttgcccagtgcagaactcctctaacgggcaactttggcttggggaacttctcatcagcctggatgagactatcttagaactacagtgtagtcgaggctctttctacccaatatttccttctcttctttttacagaagtcagacctgcaccacagtctgaagtctctctgccaattcctgagccttcccactttatccttcacaaacatttcccccaataaatatcttgcatgtctaatcccttcttggcatctgcttctctgaggaccagaacagacaggtggtttaccaagtggtgcaagaaaacagatagtaagatgggttttgggcaatggcttacttggtccctggcacaaagcagccatctgagtcctgatttagccagcagtgacctaggaaaacatcccagagaagggaaatcctcttgctcgtgcaatttaggcatttaaaagatatggggnatacgatgcctacaaagaaagcagagctggccaactgttactaagacaagtaatgccttgcagatggataatgagaaaccgagagcacttaaacagttaaaggntaagtgtgggagccgggggcttctctggagcttaacaaacttttatttcctgcagnggaagagcagaaatgggattggatggtcacagagctctaaagatatttgaatgctcagcctagggagatccagtatgtagtcagggcnctggttggggaaaccagcctgaagctttgaaacatggaatgggtgcccctgaggattttggctctgtagatacctctggacactcaagagcttacagaactggctcatacttcctagtaagagcaagcacttccctcattacagaaagacctcttccataattgttctcagtttttctcctggctgccaagccatggtaactggngttaacatctcagcataatctgcctaggaactgctggccctgataagaaaggaaagattacacaccgaaggaattgaaataagttaccatgactatcaggagccagagaagtatacttaggattggattttaagggtgttcaattaagggggctggaatttaagacaacataagcaagacttcatggacttggggtacttttttgggacagatttaacctcagcaagtagtcccgaggttagcttttcaaagcctggaaaaggngatggctttgaaaaagtggaaatgaattcacaccatggcagcttttaacttgaggagaagatagctatttattttggcatatttatgtggttactgctcacttactagtcncaattgttttgtaaccactttttatttattttttgagatagtctcattctgttttctagatgtgctacagcctgggcgacacagtgagactccgtctcaaaaaaagaaaaaaaaaaaaatatcatattgtattggccatcccttgtttcatattcgttaataaactttgctactttgctttctaatttcggtgaagaacaagcacaagattaaggagtaagactatgtgaaactgggttataaattgaaaggctgttggctgttgtatcttgtaaacaattcaacgcaatgccaagtgaaaatgaagttgttagtccctctatctagaattctttcccaaatagctgcatatctttttcctctgcttcatttaagtctgtgctgaaatgttatctactcagagaagacattctggatcatttcatattaaatagtaacttttatcactcn

SEQ ID NO: 408027 - DNA, 458 bp, Homo sapiens
gtttgtagggttaggtgcttcatatgaaaacagtggactgtgtgaattgctgttgcagcaggagtcagtcataaggtaaatgttcccatgtggcaggtagacttggccttaattttttgccctctcaccttgatacagggtatcactgagccaataagaccaggctggagtttacaccttctaggtgcacttagtgggatccatgtctaatgccagtaccctctaggttgcagatgtcttttggtgggtgttgggacatagctgtcttcctttccaccttcctgaaatcctaaattcaactggagggaagcccaacacacctgcttagaattgaggagacagggccggacacagtgactcaatcctgtaatcccagcactttgtgaggctgaggtgggaggattgctttgagctcagcagttcaagaccagtgggcaacatggtgaaaccccatatct

SEQ ID NO: 408028 - DNA, 502 bp, Homo sapiens
  misc_feature (496)..(497): n is a, c, g, or t
  misc_feature (499)..(499): n is a, c, g, or t
atgcaacattgtaatgtttcagttcttaagcagagtgctgaggaaatgatgttattttgtactttttggttcggttcaaatagttcatcattaagttaatggaaacaatgaacatggattttacagtcagacagacctgagttttaagttcacttctgccacttactagctgtgtgacctggagcaatcatgtaacctctctgggcttgttaatcatctgtaaaacagggctcacagggctgtgtgaggattacccttgacattcttacactccttccgggagtcccagagtgagtgagaccaaaccgggacaatcacagctctccaccaacctcaggcaggggcaggttgctaactgccttccaggcctcaaacttcgccatcacagaaagatggcaccacctcctcaggcaggaggttgtagtgagccaagatggtgccactctctgcactccaacctgggcaacagagcgagaaaagaaaaccgtctcaaagnngnaaa

SEQ ID NO: 408029 - DNA, 698 bp, Homo sapiens
atgcaacattgtaatgtttcagttcttaagcagagtgctgaggaaatgatgttattttgtactttttggttcggttcaaatagttcatcattaagttaatggaaacaatgaacatggattttacagtcagacagacctgagttttaagttcacttctgccacttactagctgtgtgacctggagcaatcatgtaacctctctgggcttgttaatcatctgtaaaacagggctcacagggctgtgtgaggattacccttgacattcttacactccttccgggagtcccagagtgagtgagaccaaaccgggacaatcacagctctccaccaacctcaggcaggggcaggttgctaactgccttccaggcctcaaacttcgccatcacagaaagatggcaccacctcctcaggcaggaggcccctaaggccggggtcagagcaaaaacaccccttccttctgggtttcttttgttaagaacagaaggagggggattctaggggaaggccgtgtagcccctgcccagatctgtttgcggatacctctgtgacctctgctaaagggtgcagcagggcaggtggcgggtcacagttctgagaaggtaacatacaaagagatcttcccttaaagatgtaggaagataaggagggggggagttgctggggaaagccccttctcccatagcccctgtgggccctca

SEQ ID NO: 408030 - DNA, 478 bp, Homo sapiens
tttaatgttcactaacatagttaaaatggatgggccaacattatcatggttctttcacctcctaagtaaatgcaaagcttttcttcactccattttgtatgtgtaattttgattgagtgggaatcttgtaaagccaaaaatggaactgaaagcccactcataagaccataagttttttttttaatttttaatttttcttttcaggcagggtattgctgtgtcgcccaggcttgagtgcagtggtgccatcatggctcactgcaacctctgcctcccaggatcaagcgatcctcccacctcagcctcctgagtagctgggacttactgttgtgcaccaccacagctggctaattgttagaattttaatttttatttttttgtagagacaaggttttaccatgttgtccaggctagtcttgaactcatggactcaggttaaccacctgccccagcctcccagagtgctgggattacaggc

SEQ ID NO: 408031 - DNA, 405 bp, Homo sapiens
aatgtggagggaagggggttttccgagggccatggatttgtacaggctgccctttgtgctacacgaagtcctttaatcaatttactcttctcagaacccctgcgaggtaggtgtcaccacccccatgtcacgcagcacacagctgctcagtaaatagtggggctggagttcggaagtccacggtcatccctcagcatcaggggcccttggatcagggcaaggggcacaagaggctcacaagcacgagagactgaaggaaagcaagaactgcctttcctaaaactgatctaagacagcgcctgctgacaggaggtcacggctgtgttccgcttcccgcttcccctttcacctgctccctgttcccacttcacaagcaacagatgcatctctcacacctagcagcac

SEQ ID NO: 408032 - DNA, 2584 bp, Homo sapiens
  misc_feature (782)..(782): n is a, c, g, or t
catgcctggctaatttttgtatcttttagtagagatgggatttcaccatgttggccaggctggtctcgaactcctgacctcaagtgatccacccacctcggcctcccaaagtgctgggattacaggtatgagccactgcacctggcccccagttcttcttttaaaggcatcacctaattaggtcaggcccactcaacagttgattaaccttaattatatttgcaaaatccctttgccatttaagatgacacaataattggaatgatatcccatcatattcacaggtcctacctatactcaaaaggtggtaggttatacagggtggatatagtgttgaaagaaggaatgaatgaaatgaatgaattctgatagctggaagcacagcaactagctttttttgtagcatgagtgagagaaggtattgagttccttattgaagaatgcagttgcaacagtttatcactagtgagctgcttcttggtaactataagacataagcagacaagaaacagcaagaaaggaaggaaggagaaaagagaacgagaaggaaatcattattttggaccgatttccggtggtggtttcaagaagttctccccaccctccagactgctgtcatttacaattgctagagaacaagagctgggagcctctccttggttctgctcctgtggcatagccatgggggatgcagaagggcagtggtgcccactaaagggaatccccgtcagctttggttttagtttccagagattgagcctctgccttaggctgagagaaanacttagtgtgagtctttatttgctcccttataatcacaggcacatgtggcacctcctcccccatctctgccccacctcttccaacagtgagatgcattaggtgtggaaaggaagccttcatttcaaaatctcctggctgcggttagctttaaaaatcaaatggaactgtggtcgtctgtgtttaatttggaagagcagaaaggatgcgtgctttgtggcgcctgcatagtgaaagtctccatgacttaataccactgcccagccttagaagcttcccatgcagacaatggccctgcttccccatcagttcttgggcttgggtgccaccttatataaacattgctgcttttagtgcatcgcagaagcaaaaggatgacacattaatagcagctggaggatctcattaaaattcggaggaaaatatgaaggctggagcctggtaatgtacagacagtaagtctttgtctgtctgattaacaattgcatgcattctaagtgccttgctggatggtaagaaccagcatttcagccagaagtaccatgttcttctccttaagaataacctatttctgtttttcaattcccttatcccctctaaaaataatatgctggtcttttggactcccttgagaactgaaacagcttagcaactggggcagtccctgagagctggtgcagaaacaactgttgctagcttggatttgaattatgcagtcagatgcttacatcgtgggagggggatgtacggggtgtgtggccttcagatgcttacattgtgggagggggatgtacagggtgtgtggccttcatgccagaaaggacagggaagcactccctggttggcgggaggaggggagatgctggggttgaggcccttacctttatttatgttgttcactggtacagccagactgcaacctctcaactcttcagacaagacctaaggccgacaaaattcactccctcatgaagaacattgggctgtttctccctggtgtgtaggtggtgggagtgaagtagaggggctcgctgtgtgcagggaaagggctgcattctcaagaatttgtatgtagcccttggactaaaaacaaaatattccaaaggaatgcttcttttggaaccctggtccagtccctcgtctaagcaggagtgcccttatatgcttgactgtggatggcatctgattacgggcagaaggttgcactggattgctgcctgatgcggacccacagaacacagtttaactctggctctgtcagcagtcatcagtgtttatttttccaactcttcagagagatattagtcgttatgaaaagtgtaccatctcagaactccatggaataagctgccaatataagacaggttgaaattattgtgtctttttgcctagagttatttttagttattttttcttccttggaatttcttttcttttttttttttaaccatatatgctaactttgtagctggtggcaaaaaaagattattttccctatattaatgacttcttcagctgaattgaggaatagggttaccagctcttttcttggagtttaacactctcaatctgataatatgaataacacctcaataaccacaacaagagcggatcatcttcagtatctttcctgaattaccttttggcttttcaccaccttgtttgtccgtttcagagtttgtctttctgtaaaatcatgggaaggcatctgattactttgttcttgatgtacctgagtaatgcgaacatctgaataattgaacaaaaatcttgtttaaacaaaacttttgtttcagaagcatct

SEQ ID NO: 408033 - DNA, 452 bp, Homo sapiens
gtttttaccacagcttttctgaaactgctattagctgaatgtcccagcctcctgaaaacatcctttaattttcttatctatttttcatccctttacatttttgttctactttctgggacagttatttaatttcatttcccaacccttctatttaaattttttggctgggcacggtagctcatgtctgtaattccagcactttgagaggctgaggcaggaggattgcttgagcccagggagttcaagaccagcctggggtaatatagtgagccacaccccccaaccccaccacatcttcaacaaaaaatttttaaaaaattaactggggcaaggtgttcacacacctttagtttccagctactcagggatgctggagggtggggagggtcacttggagttccagggaggtcaaggctgcaggggaaccatggatccaggccgtgctactccag

SEQ ID NO: 408034 - DNA, 1502 bp, Homo sapiens
ttttctataaagaaaccacaaagtattaagcccttaatcagcttaagtattagtacttgagtattaatccattccaaattgaacctaatgcctgttgccctaaagcagtggttcttaaaatgtggattcctgaatatagttgtcagataaaatatgggacatccggttaaatttaaatttcagataaacagtgtttttagtatgtgtacatgccatgtaatatttggggcacatttatactaaaaaaagtatttattgtatatctgaaattcaaatttaactgggcatcctgtatttttatttgctaagtctggcaactttatccctgaggcccttttaggagttgcctgagttcaaaaatattttctgataatactaagtgattaattgccatttttcactgtgttgacatttgcactgttggtgcagcagcattgaggagtagaactacttgtatcttagcaagaatcaaggcagaggcaataaattactagtagatgtcacaataaaaaaatgtttaatgccatttgaacttaagaacttcctttatgaagagataaaaattattaattttgttaacccttgaccctgagtacgcacctttttagtattctgtgtgacaaaatgggaagcacacaaaaagtgtgtctgccccatgcccaagtgtgatgaacaatcttgtgtaattgttcaagttggactgagctagccacttttttcaaagacaatatttatttgaaaggaatgacaactatggttatttagaagaaaacagttgatagtgtttattgccaatgaaaaaaattaaaactttcaagcaaaaattgaaattacggaaaactttgtcatcgtgagcatgatggcttctcagtacttaaaatctcttctgattaaatggatggcaacattcacaaatgtgagggccacacgcagcagctcatgcctgtcatcccagtgctttgggaggctgcggtgggagaatggcttgaagccaggggtttgagaccacctggacaatatagcaagaccttgtctctacaaaaaatacaaaaattagcctgagtatgatggcatatgccaagactcttagctactctggaggctgaggtggggggatcacttgagttcaagagttcaaagttatggtgagctctgatggtgccaccacactccagcctgggtgacagagcgagaccctgtctctttaaaaaatttttttggctgtgcacggtggctcgcgcctgtaatcccagcactttgggaggccgaggtgggtggatcatgaggtcaggagatggagaccatcctggctaacacgatgaaaccccatctctactaaaaaatacaaaaaattagccagacatggtggtatgcgcccgtagtcctagctacttgggaggctgaggcaggagaatggcatgaacctgggaggcggagcttgcagtgagccgagattgtgccactgcactccagcctgggtgacagagtgagactctgtctca

SEQ ID NO: 408035 - DNA, 1442 bp, Homo sapiens
taaatgagcgaatgaaaatgctacataggctccctgagttctttcatgtacgaatcttggttacacatcttagaacagcagagctgcctgagggagggttgtgtttaatgtcgtatgcatgctcagcacagtgctggcatggcccatccatgctttctgttgaactatggacagaattcaggaacttgtgtatggagagggtggaagtcagtcctcgcttctttccctaaacattttgcagtgacagcatatggatctttggttggaaaccccatgacactcttctctacttccccatgggccttccctggtttttgtttttcttttcttaaacaatcctggtaatgacacttccaccacaatgagcttttaaatgtcctttaatgataagccagtgtttccttcagagggcaaaggggagactgctgagtcactgtggccatttttagataaaccttttcctgtttataataacacatgctgattgtaggaaactagaaaatacatgaaagtgcagagaaaagactaaaagtcatctatacttcaggtcgtagaaataaccactctgaacagcacacttctttttacactattgttttacactgttgggattacataaatatatatgtttgtatcccactttgtgaacatcattctatgtgaactagaaatggttcctaaacattaagggctgcatatagctgtatcatagtttatagtttatacatagatgctttgtaacattattttataatgctatgaatgctatggtgaatatttttgtgaatcaacttatgtttccaccagcagtttcagagagtgcctgtctcatcccatcctccccagtattgcatattcttgagtcttttattctttgataatgacaaatgatgaatcattgatagtttttcttcataataagtaaagtttaacattttcaagtgtttgttgaccatctgtatttcttcttttgtgaagtgctgtcagttcttttgctattttaaaaataattttgagtttcagtttttgtttgttggtctgtatgaaccctttaaaaataaaggctgttagccttttgccatcttagttgtgacagtaaagtataatgctttgctgcactaggtcctctggaacaagatgcagatttagattccaggtcagcatgtaacttgaccactgtcactcaagagttacagcctgagcagggccttaggagggagatgatttctgcttaaaggcgatacaaattcctagttagggaaatagaaggaaagtattctcaggagattaatttaaggcagcttttttgttggtttaagcacctctaacattttcatactaataagggagaatgggatggcggctgaaagagacacaaatattgtatcatttaattctaaattatgtatttgtcaggttcttattgaaagagtaaattttcg

SEQ ID NO: 408036 - DNA, 1602 bp, Homo sapiens
  misc_feature (1415)..(1415): n is a, c, g, or t
taaatgagcgaatgaaaatgctacataggctccctgagttctttcatgtacgaatcttggttacacatcttagaacagcagagctgcctgagggagggttgtgtttaatgtcgtatgcatgctcagcacagtgctggcatggcccatccatgctttctgttgaactatggacagaattcaggaacttgtgtatggagagggtggaagtcagtcctcgcttctttccctaaacattttgcagtgacagcatatggatctttggttggaaaccccatgacactcttctctacttccccatgggccttccctggtttttgtttttcttttcttaaacaatcctggtaatgacacttccaccacaatgagcttttaaatgtcctttaatgataagccagtgtttccttcagagggcaaaggggagactgctgagtcactgtggccatttttagataaaccttttcctgtttataataacacatgctgattgtaggaaactagaaaatacatgaaagtgcagagaaaagactaaaagtcatctatacttcaggtcgtagaaataaccactctgaacagcacacttctttttacactattgttttacactgttgggattacataaatatatatgtttgtatcccactttgtgaacatcattctatgtgaactagaaatggttcctaaacattaagggctgcatatagctgtatcatagtttatagtttatacatagatgctttgtaacattattttataatgctatgaatgctatggtgaatatttttgtgaatcaacttatgtttccaccagcagtttcagagagtgcctgtctcatcccatcctccccagcccattcctgctgtcaaacaaacaaaaccttgcaaagcgaaaaaaaaaaaaaaaaaaaaaaaaaaaaaaaaaaaaaaaaaaaaaaaaaaagaagaaaaaaaaaaaaaagaaaaaaacaaacaaaaaaaaacgaaaagaagaaaagtcacaatacacaaccacatcacaccaagaccaagggaggggagagcgcaaaaaaaacacatacatggcagacaagacacgcacccaacacaacacttataaacaaaagcaggccacacacagcagcgcgaccacacaacacccaccgcgagcgccgcgtacacacaaccagcaggccggccggggacaacacacataacacgccgggagagatcaaccagacaagcaaccacccagcgggaggggggcgaaacctaggcgcgcacccacccaccgaacatgaacgccggacggggcatcattaacacagaaatggtggctagcagtcgactccacacacacgatcacaatcgctgcgtgacgcaaagatgtcggacgaagcgttagcaacaactaagcgccacgggtgccgcaatcaccaacangtcaggcagtccacggtagcgaaagacagaactagccagaagaaagaaggaacgcgaggatgcgtccagtcacataaagacccagctgatacgacagaatacgaccacagaagccccggacgacctgccattatctcgtgcatagccagctgaacgacaatgcacacaacacagaaaagaacgaaaa

SEQ ID NO: 408037 - DNA, 455 bp, Homo sapiens
cattgggcctgctaactgggggttccttgacgtctgaaagccaagccaagcctcctggtcttgtttagggggaggtccccaagcattccctgccccagtcctttgtgagatttgcatctgactgcaaaggatggaagaaaaccagggcaattaggtgagtgttgcctaaattaatctgcccattaaaatattctaaagagcatttccttcctttttggaggatgaggacttctacttatctgacagcaattctagtgtgtttttaacattttaatatgaagagtttccaaaacttggaaagaatcggatttggaaagaatcggatggtgaaccctcagacctaccgtctagattctatgatcatgttaagtttttctcataagagatggcatgaaaactttgtctaagcaaaataaagtggagaacccatttgggttcctcggttaaaaacattt

SEQ ID NO: 408038 - DNA, 883 bp, Homo sapiens
gatgtcttctaggcaactgatgaaaggaggaagaagaaagggacttggaacaagcaagaaaatgagcctaatggtggcccatgtgatcaaatttgcataaggacagaagacaagaccgaaggagctgatgggtagagaggagatattgctgtcaacagagtggaggtctcagtggggaaagatgaactctactggaggttcagaaaacaactgtgaaagaaatacttgaggcatgtttcaacagactgcaaatataccatctaattcttggaaacaagtacaagataaattgattctgaagctgagggctttgggcagcaaaatctgactttccggaagaggtgtaagatggtgctggtggagctttgtaaggattctctgcagggctagagttctgagtccacaggtcctctttgcaaagcccgcatgtgtgatgcccaccttcgaggcccctcgggcatcatcacctcccccaatttccccattcagtatgacaacaatgcacactgtgtgtggatcatcacagcactcaacccctccaaggtgggaggagacccagggaacatacaatgcaacaaggagggtctaagtgtggaaactcaaagtctaagactgaggaatagaagttgtcttctgggaaacagcaaggacaatggatgctgtgtgcctaaccctgttcatggaactggcctacaggtgagatacaggtgtatccaaggactgcctatccactcaccttcagacatctccttcagcaaaaagcatagtctctaagctcacagtatgttttatgagatgagcattcattcattcattgatgtagatatggcctctgcccttgaggagtgtgcacgtaagagtgaagaacaggtctgaaaaaaaa

SEQ ID NO: 408039 - DNA, 684 bp, Homo sapiens
gccttgtagtaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgggaggagacccagggaacatacaatgcaacaaggagggtctaagtgtggaaactcaaagtctaagactgaggaatagaagttgtcttctgggaaacagcaaggacaatggatgctgtgtgcctaaccctgttcatggaactggcctacaggtgagatacaggtgtatccaaggactgcctatccactcaccttcagacatctccttcagcaaaaagcatagtctctaagctcacagtatgttttatgagatgagcattcattcattcattgatgtagatatggcctctgcccttgaggagtgtgcacgtaagagtgaagaacaggtctgaaaaaaaa

SEQ ID NO: 408040 - DNA, 474 bp, Homo sapiens
gccttgtagtaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagatttaaacaactgcttttaaaaagttagtggagaagaagaaagctaagaagaaattcggtcagaaacgtaggagaaaagccaaaaagcgtcactgaagccaaagaatcccgcatgtgtgatgcccaccttcgaggcccctcgggcatcatcacctcccccaatttccccattcagtatgacaacaatgcacactgtgtgtggatcatcacagcactcaacccctccaaggtaagcctcttggggagcggggt

SEQ ID NO: 408041 - DNA, 375 bp, Homo sapiens
gaaataatttatattttgattgaagcatggtgagaacttttatagaaaatcctatttttaaaaatttttctttcctttatcacagattacaatggctaatctacatgaatgactatttttcttctattgacaactccttctgcaaaattatttttatttattttcttgagttatagatttagggggtacaaatgcagctttgttacatggacatattgtgcatggcgaagtctgggagaaatcttccgcatacacctattcagaaacactagatttcacctaatttaaatcaccattctctaacaggtcaagaatttaaataaaaactgattacaaccaacatcatcattctaacttttaaacaaaagcatgtaa

SEQ ID NO: 408042 - DNA, 1961 bp, Homo sapiens
ggtgtaacggcccgaatctgggatgcctgctcggtgagttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaaaacaccttgagaggacaaccctgcaaagcacggcacagtggccgagagggaaaggagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtagctgggactacaggcatgcgccaccacacccagctaagttttgtatttttttagtagagtcagggttttactttggccaggctggtcttaaactcctggcctcaactgatctgcctgtctcggcctcccaaagaactgggattacaggcatgaggcaccgtgcctgtcccatgttgtacttaatagatatttaccatatacaattattttttaatttaaataaatcaatgaacagtgttatttttt

SEQ ID NO: 408043 - DNA, 1733 bp, Homo sapiens
agtattctgccagcttcggaaagggagggaaagcaagcctggcagaggcacccattccattcccagcttgctccgtagctggtgattggaagacactctgcgacagtgttcagtccctgggcgggaaagcctccttccaggattcttcctcacctggggctacttcttccccaaaaggcatcatggctgccctcagatcccttgtgaagcccaagatcgtcaaaaagagaaccaagaaattcatccggcaccagtcagaccgatatgtcaaaatcaagatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaaaacaccttgagaggacaaccctgcaaagcacggcacagtggccgagagggaaaggagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtagctgggactacaggcatgcgccaccacacccagctaagttttgtatttttttagtagagtcagggttttactttggccaggctggtcttaaactcctggcctcaactgatctgcctgtctcggcctcccaaagaactgggattacaggcatgaggcaccgtgcctgtcccatgttgtacttaatagatatttaccatatacaattattttttaatttaaataaatcaatgaacagtgttatttttt

SEQ ID NO: 408044 - DNA, 2859 bp, Homo sapiens
ttgccttttccctgtcaggacccagaggttacctcccatcagccccggcgctctctcatcccttctctcttccttggtgcttctttttcctgctcggtgagttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggagcaaaaaaaaaaaaaaaaaaaaaaaaccagaaagcacgtgctgcccagtggcttccggaagttcctggtccacaatgtcaaggagctgagagtgctgctgatatgcaacaaatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaagagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtagctgggactacaggcatgcgccaccacacccagctaagttttgtatttttttagtagagtcagggttttactttggccaggctggtcttaaactcctggcctcaactgatctgcctgtctcggcctcccaaagaactgggattacaggcatgaggcaccgtgcctgtcccatgttgtacttaatagatatttaccatatacaattattttttaatttaaataaatcaatgaacagtgttattttttaaatcttgtggctttaatacaccctttcaattctcagggagtgttttggtgatacaggctggggagttaaataaatgaacgaataaacttagttgttatccattcaaaaaaaaaaaaaaaaaaaaaaaaaaaaaaaaaaaaaaaaaaaaaaacaaaaaaaaaaaaaaaaaaaaaaaaaaaaaacaaaaaaaaagaagagagagagagaagagaagaaacaaataacaaatcaaaaaagaagaagcaacaaaaaagcaaagcgtaaacaacacagagagcgcgggcgcgagcagaggcgagccccccttgagtgagaacacattataaaataccgcagcgaagacgagggtagcgtttacagaaagacggagcagcgttcctcgagcgggagggacaacttcacctattaacaacctgaatctagcttgtggaagaacagaacaacaccactcggtcggagggaggacacaaacaaatgacgtgataacagtaacatctccatcctctgcatcgaaaggattaccacacccccgttcgggcggcgagacaaaaataaatgatagtgaaagttacatactacagcggtagcacaataaacgacacgtcagactactatgatcggctataatagtcataaatgtttgcgagcacaagccgccgagtttattcgatcacgagacctctt

SEQ ID NO: 408045 - DNA, 2015 bp, Homo sapiens
ttgccttttccctgtcaggacccagaggttacctcccatcagccccggcgctctctcatcccttctctcttccttggtgcttctttttcctgctcggtgagttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggagcaaaaaaaaaaaaaaaaaaaaaaaaccagaaagcacgtgctgcccagtggcttccggaagttcctggtccacaatgtcaaggagctgagagtgctgctgatatgcaacaaatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaaaacaccttgagaggacaaccctgcaaagcacggcacagtggccgagagggaaaggagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtttctcataataaagacagattgcttcttcacttg

SEQ ID NO: 408046 - DNA, 1250 bp, Homo sapiens
ttgccttttccctgtcaggacccagaggttacctcccatcagccccggcgctctctcatcccttctctcttccttggtgcttctttttcctgctcggtgagttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggagcaaaaaaaaaaaaaaaaaaaaaaaaccagaaagcacgtgctgcccagtggcttccggaagttcctggtccacaatgtcaaggagctgagagtgctgctgatatgcaacaaatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagagatccaaagaaatcctgaggaagcacaacaaacaaaaacactctggatcagaacttcctgtgccagcgttacatcagggttttctagcagcaagggcgggctccacatggctgaagcaggcaaccaggaggtaggcagggcccggccctgaggggctgagttgggggagtcccaggtctcgggaagagtgatctcaggctgccctgcaggtgttcctgggggatcctgggacagcatcagggacgctggcccccagtgcttccttcccatctcacaaatgggcatttgttcatcggctaaacaacactttctagact

SEQ ID NO: 408047 - DNA, 2701 bp, Homo sapiens
ctgcaaagagaacagaaggggtgctgctgtaggaaataaatgaatggctcagaagaccacactgaggaagttgtgagttgataatggaagatctccaggtttgaggcatccttagagggatatgatggttttgtgtgtgttgggggtgtggtagcgcagctgctacctagggaattagaaggttttctttattgaacatttaccctgtgacaggtactgcaggcattcagcacacaatgtcgtctccattttacaggcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggagcaaaaaaaaaaaaaaaaaaaaaaaaccagaaagcacgtgctgcccagtggcttccggaagttcctggtccacaatgtcaaggagctgagagtgctgctgatatgcaacaaatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaaaacaccttgagaggacaaccctgcaaagcacggcacagtggccgagagggaaaggagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtagctgggactacaggcatgcgccaccacacccagctaagttttgtatttttttagtagagtcagggttttactttggccaggctggtcttaaactcctggcctcaactgatctgcctgtctcggcctcccaaagaactgggattacaggcatgaggcaccgtgcctgtcccatgttgtacttaatagatatttaccatatacaattattttttaatttaaataaatcaatgaacagtgttattttttaaatcttgtggctttaatacaccctttcaattctcagggagtgttttggtgatacaggctggggagttaaataaatgaacgaataaacttagttgttatccattcaaaaaaaaaaaaaaaaaaaaaaaaaaaaaaaaaaaaaaaaaaaaaaacaaaaaaaaaaaaaaaaaaaaaaaaaaaaaacaaaaaaaaagaagagagagagagaagagaagaaacaaataacaaatcaaaaaagaagaagcaacaaaaaagcaaagcgtaaacaacacagagagcgcgggcgcgagcagaggcgagccccccttgagtgagaacacattataaaataccgcagcgaagacgagggtagcgtttacagaaagacggagcagcgttcctcgagcgggagggacaacttcacctattaacaacctgaatctagcttgtggaagaacagaacaacaccactcggtcggagggaggacacaaacaaatgacgtgataacagtaacatctccatcctctgcatcgaaaggattaccacacccccgttcgggcggcgagacaaaaataaatgatagtgaaagttacatactacagcggtagcacaataaacgacacgtcagactactatgatcggctataatagtcataaatgtttgcgagcacaagccgccgagtttattcgatcacgagacctctt

SEQ ID NO: 408048 - DNA, 861 bp, Homo sapiens
ggtgtaacggcccgaatctgggatgcctgctcggtgagttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctgatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagagcttttctggagaggctgacactttttaaggtcagacaagagacatttgccatctattctctctgaagtttgctacctgaaggcttcatctacatgaaaagaacctgggcttggctgggcactgtggctgacgcctgtggtcccagcactttgggaggccgagatggagtctcgctctgttgccggggctggagtgcagtggcgtgatctcagctcactgcagcattcacctcacgggtcaggccgattctgtgcctcagctcccgagtactgggattgccagcctgcgcaccaag

SEQ ID NO: 408049 - DNA, 2024 bp, Homo sapiens
ttgccttttccctgtcaggacccagaggttacctcccatcagccccggcgctctctcatcccttctctcttccttggtgcttctttttcctgctcggtgagttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaaaacaccttgagaggacaaccctgcaaagcacggcacagtggccgagagggaaaggagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtagctgggactacaggcatgcgccaccacacccagctaagttttgtatttttttagtagagtcagggttttactttggccaggctggtcttaaactcctggcctcaactgatctgcctgtctcggcctcccaaagaactgggattacaggcatgaggcaccgtgcctgtcccatgttgtacttaatagatatttaccatatacaattattttttaatttaaataaatcaatgaacagtgttatttttt

SEQ ID NO: 408050 - DNA, 2913 bp, Homo sapiens
ttgccttttccctgtcaggacccagaggttacctcccatcagccccggcgctctctcatcccttctctcttccttggtgcttctttttcctgctcggtgagttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggagcaaaaaaaaaaaaaaaaaaaaaaaaccagaaagcacgtgctgcccagtggcttccggaagttcctggtccacaatgtcaaggagctgagagtgctgctgatatgcaacaaatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaaaacaccttgagaggacaaccctgcaaagcacggcacagtggccgagagggaaaggagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtagctgggactacaggcatgcgccaccacacccagctaagttttgtatttttttagtagagtcagggttttactttggccaggctggtcttaaactcctggcctcaactgatctgcctgtctcggcctcccaaagaactgggattacaggcatgaggcaccgtgcctgtcccatgttgtacttaatagatatttaccatatacaattattttttaatttaaataaatcaatgaacagtgttattttttaaatcttgtggctttaatacaccctttcaattctcagggagtgttttggtgatacaggctggggagttaaataaatgaacgaataaacttagttgttatccattcaaaaaaaaaaaaaaaaaaaaaaaaaaaaaaaaaaaaaaaaaaaaaaacaaaaaaaaaaaaaaaaaaaaaaaaaaaaaacaaaaaaaaagaagagagagagagaagagaagaaacaaataacaaatcaaaaaagaagaagcaacaaaaaagcaaagcgtaaacaacacagagagcgcgggcgcgagcagaggcgagccccccttgagtgagaacacattataaaataccgcagcgaagacgagggtagcgtttacagaaagacggagcagcgttcctcgagcgggagggacaacttcacctattaacaacctgaatctagcttgtggaagaacagaacaacaccactcggtcggagggaggacacaaacaaatgacgtgataacagtaacatctccatcctctgcatcgaaaggattaccacacccccgttcgggcggcgagacaaaaataaatgatagtgaaagttacatactacagcggtagcacaataaacgacacgtcagactactatgatcggctataatagtcataaatgtttgcgagcacaagccgccgagtttattcgatcacgagacctctt

SEQ ID NO: 408051 - DNA, 1588 bp, Homo sapiens
ttgccttttccctgtcaggacccagaggttacctcccatcagccccggcgctctctcatcccttctctcttccttggtgcttctttttcctgctcggtgagttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggagcaaaaaaaaaaaaaaaaaaaaaaaaccagaaagcacgtgctgcccagtggcttccggaagttcctggtccacaatgtcaaggagctgagagtgctgctgatatgcaacaaatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggtgagtgtggggcctgctctgagtgctaaacacaggcagtctctgtgtctcccaaggaacccaatcgctatcacatttgctttaaatatttagagacgcacgatttgtttccttgtcagtcaaagccaagaggtggcatgtgatgacatgctgccaaatgctcagggcacagacggaaactttcatgtcaaccctgacatagtcaccacagatctcaatggccttgacgtgctctcctgctgagatttacatccccacggtgactttgggctctttcatatttctggcccagtcagcctgtttggtgattagcatctttgtttctttggggtctccagatccaaagaaatcctgaggaagcacaacaaacaaaaacactctggatcagaacttcctgtgccagcgttacatcagggttttctagcagcaagggcgggctccacatggctgaagcaggcaaccaggaggtaggcagggcccggccctgaggggctgagttgggggagtcccaggtctcgggaagagtgatctcaggctgccctgcaggtgttcctgggggatcctgggacagcatcagggacgctggcccccagtgcttccttcccatctcacaaatgggcatttgttcatcggctaaacaacactttctagact

SEQ ID NO: 408052 - DNA, 2533 bp, Homo sapiens
ttgccttttccctgtcaggacccagaggttacctcccatcagccccggcgctctctcatcccttctctcttccttggtgcttctttttgcatcatggctgccctcagatcccttgtgaagcccaagatcgtcaaaaagagaaccaagaaattcatccggcaccagtcagaccgatatgtcaaaatcaagcgtaactggtggaaacccagaggcattgacaacagggttcatagaaggttcaagggccaggtcttgatatgatgcccagcattggttataggagcaaaaaaaaaaaaaaaaaaaaaaaaccagaaagcacgtgctgcccagtggcttccggaagttcctggtccacaatgtcaaggagctgagagtgctgctgatatgcaacaaatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaaaacaccttgagaggacaaccctgcaaagcacggcacagtggccgagagggaaaggagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtagctgggactacaggcatgcgccaccacacccagctaagttttgtatttttttagtagagtcagggttttactttggccaggctggtcttaaactcctggcctcaactgatctgcctgtctcggcctcccaaagaactgggattacaggcatgaggcaccgtgcctgtcccatgttgtacttaatagatatttaccatatacaattattttttaatttaaataaatcaatgaacagtgttattttttaaatcttgtggctttaatacaccctttcaattctcagggagtgttttggtgatacaggctggggagttaaataaatgaacgaataaacttagttgttatccattcaaaaaaaaaaaaaaaaaaaaaaaaaaaaaaaaaaaaaaaaaaaaaaacaaaaaaaaaaaaaaaaaaaaaaaaaaaaaacaaaaaaaaagaagagagagagagaagagaagaaacaaataacaaatcaaaaaagaagaagcaacaaaaaagcaaagcgtaaacaacacagagagcgcgggcgcgagcagaggcgagccccccttgagtgagaacacattataaaataccgcagcgaagacgagggtagcgtttacagaaagacggagcagcgttcctcgagcgggagggacaacttcacctattaacaacctgaatctagcttgtggaagaacagaacaacaccactcggtcggagggaggacacaaacaaatgacgtgataacagtaacatctccatcctctgcatcgaaaggattaccacacccccgttcgggcggcgagacaaaaataaatgatagtgaaagttacatactacagcggtagcacaataaacgacacgtcagactactatgatcggctataatagtcataaatgtttgcgagcacaagccgccgagtttattcgatcacgagacctctt

SEQ ID NO: 408053 - DNA, 445 bp, Homo sapiens
caggatccctattttatagacaagaaaactcagaggtgctgagagcagtgtctgcacctgtgctcgccatctcaatatctacacagtcccctcgcatcccattggtgtctccatttcttgggagtgagaatggcgggggtgcctgccttcctagtggcaaaagccacgagctcctggtttttcccaccaaaaaagcatgtaaggaaatagtgaagtcctattaccaaaggcaactactgtgtggcatacttccttttcatttggtccttttttccctcccctatggaacagttggcagtctgcacagatgctaacccacctgtgtattatttccttcagcgtaactggtggaaacccagaggcattgacaacagggttcatagaaggttcaagggccaggtcttgatatgatgcccagcattggttataggagcaaaaaaaaaaa

SEQ ID NO: 408054 - DNA, 365 bp, Homo sapiens
atgattccgtatcaaattttaacttctagatgtttatttttttaactgcagtcaaggcacaaaccagtgtaaatcagctgcacaaatgtttgtcataataaatttttattaggttttatattggaagccatttagaaactagtcttataatcactcataaaacattagctatcttattgtttttcaagagtatgtagagtatagtaattttttagtaacatcccaaatccgtctttctccaaacacaatacagcaaaaatgtgttttctgtgattcagtaagtcagattgcattttgagtattcatgtagttttccccacccccctgaatcaggaattttcttcccccattattattgttttctt

SEQ ID NO: 408055 - DNA, 388 bp, Homo sapiens
  misc_feature (7)..(7): n is a, c, g, or t
tgccccntccaccatgtgaagatacagtgagaagttgcccatctggtatgggaagcaggccaccccccagataccaaatctcccagcgtctcaatcttgaacttcccagcgtccagaatggtgagaaataaatgtatgttgtttataagccaccaagtttatggtattttattatagcagcctgaacagactaagacagcctgactttaaataagttaggaggatatccagcaattggcctcctccaactgtggaaccaagaagagtgtgcaccttactcatggtttctgtcttgtaagcagtaagccttggacaatatacatactttctcttagcccctatttcctgatccaaaaagttaggatatatatatcttataggaatgtca

SEQ ID NO: 408056 - DNA, 925 bp, Homo sapiens
tagcactttgggaagccgaggtgggcggatcacttgaggtcaggagtcggagaccagcctggccaacgtgatgaaaccctgtctctactaaaaatacaaaaattaactgggcgtggtggtgtgcgcctgtaatcccagctactcgggaggctcaggcatgggaatcgcttgaacccgggagacggaggttgcagtaagccaagattgcgccactgcactccagcctgggcgacagagagagactctgtctcaaaaaggattattaaaaaaaaaaagaattgtagaatgttttaggataatataaaggagtcatgtttttttccccaaccgctacacacttaaaataaacaacctagagcaaaatactactttatcttaattctttttttttccccttaggcatctttcttgcaggatcgtcttaagtctttataagttcttagtcatttagattgaatacaagtaacctgcatagaaatcccatttgtatcaatagagaacttgactatttttagtgaattatactatctttaacatgtttatctgcatggggatgaacttttgaaacacaatagtttgagtgagtcaaatgatgaccatttggtagtcacttgaatattacacataaattgacacaatgacttttgacataaaaatttcaggagtcatttctatttgtagggactgctctgtttctttatttacataaagtatttcagaaaattttcaatttagccaagttctacatttagcataacatattgcacaaatatctttctagtttttattgttagacactgactttattctatagtgctgaatgcactgtgtgagaacagtcacgtcaagttatttaagtggtgcttcagaaggaaagactgaaattaatgccacatgtatcctgaacttaaattaaaataaaata

SEQ ID NO: 408057 - DNA, 503 bp, Homo sapiens
gtcttttttttttaactgaggcccagagaagggcagcggcccactgaaggccatgcacaagctaaggtcctctggttgatggctccaaggctgtttcctcctcccagcctccctataatcctaggcaagggtaagtacagggtcactgagtatgcatggcaggtccaaccttatgcaagctgctttccttggggtaagcagtggaaaacacttccaactaaggactttaatttcaggtcttccattaatgtggccaagtccctgcccctctctggatcccaatttccctatctgtaaagtgaagtaggcgagtttggtaatcttttgctaaaggctcagccagttctgaacctctgaggttctaattagaaagtactgcaaggggccgggcatgggtggttgcgcctgtaatcctagcactttgggaggccgaggtgggaaggtggcttgaggccaggggtttgagacaagcctagacaacatgatgaaatccatctctatta

SEQ ID NO: 408058 - DNA, 3442 bp, Homo sapiens
  misc_feature (290)..(290): n is a, c, g, or t
  misc_feature (1382)..(1382): n is a, c, g, or t
  misc_feature (3136)..(3136): n is a, c, g, or t
ctgacctcaggtgagccacccacctcagcctcccaaagtgctgggattatgggcgtgagccaccacacccagccgtctctctttttttttcaaggacaccagtcatatgggatttagtgcttacacactccagtgtggcctcatcttaagtaattacatttgcagcaaccccatttctaaatgaggtcatattctcaggttctgagggttagggcttctacatatctttctggaggatacagcacactcaattcctaatagcaactgaagcttcttcttaaacaaaaaanaaaatactcttatttcagttatcatattataaagtgttctgaatcctattggaaactttcaacctcttttttgatatttgttgtaatgactattaaaaatagcataaatttaacatagaaatttaaaaatatattacaaaaagtctgggcacggtggctcatgcctgtagtcccagcattttgggaggccgaggcaggaggatcacctgaggtcaggagttcaagaccaacctggtcaacatggtgaaactccatctctactaaaataatacaaacattagcaggtatggtggcaggcgcctgcaatcccagctacttggatggctgaggcaggaaaatcacttgaacctgggaggtgaaagttgcagtgagctgagatcgcaccattgcactacagcctgtacaacaagagtgaaactctgtctcaaaaaaaatgaataaatgaataaaaaaattaaaaaagtataatgaaaataatcacgcataaagacttgttaattataatattcatatatttgtatttatgtaaaaacattttttattatgcatacacaataatatattttatggttgtgcagcattcaatccatccagttgtattcataatatacaccgaccagctgtaaggtcttatatttagagttcttattataaatgcgtatctattttttcaaatatgacttactttaagcacttttgtagtctctttgagactaagatatttgtctacattttacagcattctgttttctctctcatggcttttcttctctttctctgatacctagcttagattatatatttatttcagttttacattgtcgtttctattcaggactgtgtacgtgctgtccatcctctcttcctgtagcagtttcccaaacttttcatataactacttctttcaggcctctacgtaacattactttgtagacaaggctttcccgcctccttgaaatatggtgtctcagtacctgtattgtaataaaacctatcacacaaatgtttctcattttattttttgtttttaatactgtagaggtaaggcctgtgacttttctatctacccagcattccccagcactcataatntatttgctcaataaatgttcctagatagtccctattttgggaatttcactgtcatcttttccctttccaagtctgaatcctagaagtctactttattacactccttctcccttaagtgaaatatacatgtatacacacacacacatatatatacacacacatatatgtgtgtataaatatatgtgtatgtaaatatgtgtgtatatgtgtgtgtgtatatatttatatatcgtttttgcctctttaatatgtcttccatatctcatttgtctttcttttgagacaaggtcttgctctgttgtacaagctggaatgcaattgcaagatctcagctaactgtagctgctgcctccaggtctcaagcaatccttccacctcagcctccagagtagctgggactataggcatgccccacaaggcctgggtaatttttctgtttttcctttttcttttcttttttattttatagagacagggtctctctgtgttgcccaggctgatcttgaactcctgggctcaagagatccacccacctggtcctcccaaagtgctaggattatagggtgagccaccccgctcagaccaatatctccgcttcttcacagccctctcaccaccttaagccttattatcacaatctcttacttgatctatgacagtactctgtaaatgatacacacttttcacacctttcctgttgtaacccattctcaattttctcaggagatactttaaaaatattatttaaatcatgtaattctattgtttaaaaccttcaatggctttaatggcttctactgcttttgcgataaagagaaaaatccttcacgttacccataggttttgactatagctactgggtttctgtccaggcaaaagtcattatttccctctttgttcctacttcaggtatatggatcttctttgagatctccaaaattttcatgttgtcttctgacttaacgaatttacacacgttgttttctatagaacaaataattctgcctgttttaattctccattcatacctaattccaactcatccttaacatattgattctaaggtcatgattcaggaaaaccttctgtaacttttcagactctatcagagtccagtatttttgcttttaaaatatattgctatattataatactgtttatagcattaattatatgttttcatatatacatatatatgcttaatttactgttagctttgcctcataatattcaaatgtaagaaatgtaaaattatttttctagagcaaaaaatacaatgcttctatttcctactgaggcttttagagaatacctccaagaaagtacaaagtttggatgagatactgaatttccagatgcgctcaaaggcatcactcactgacagccacttctgaccagagactgggacagaaatgaatacctttcctggtgtgcccaaggccttggtattaagtaactatctatcttccacctgtctctacagttatccaccatggaatgagcagtgctagacacagatgcattggtccttacatatgggaaaatgtgaaactcacttaccttttctggtcataggaaagaaattaatcatccgtcttgccagttaagtgtcattatctcatctcccagagccagacttgcttacttctctccctgagccattttagaacagagtttggcagtgaagtatgtgtgtttggagatggggggaaaggggagacatttgttgacttctgggaatcttatgtcttgtnatttcaactgtgcaaaataaaatctattgtttctcttcatcaaggaacccagaaaaataatatcaggattgtgtttgtatcttagagcacagtagtaaaagtatttcttatttaaaaataaaatcctttgggaatgtgttttttatatcacttgtttttgattcacaatatacaaacgctcatggaaaaaaaaagcaatacaaagggtcaaaccagtaaaaatacactcttttccctcatagacttagtttttctccccaaatgcagcctcaatactaattgtttgtgtagctttcaaagacacaa

SEQ ID NO: 408059 - DNA, 769 bp, Homo sapiens
tttgcttttctctctgatctgactaacctctttcattctttgccctatgttatatggcttagaccaaagcctgagacatttaaccaatttataaatattaaatgcagaaggcatactttatcagttcctggaaacatcaaagaagctggaaggggaatggaaattggatggcactttgtggaggtcactttgctgacagtcaagtattcaaagatctcctaagatacccggtctttaaagtattatacaaaatatcaggcccagtcccaaggcgcaacttgtgccagcagcccgcgccagcagcctgcaccagcaaaatagcagtagcaagaagagagccagcagaagacacctaccctggcccggaagacgcgtacccctgaagattgaggaagaggccatccgggtacaacgtagcagttacgtcagactaagacacttcctgtttataggagactataaaacctttgccctgtcctcactaggggctgacaccattttagtcctcagaccgcctgcacccaggcgctcattaaaacagcatgttgcttccaccgcctcatgttgtctgttggcgcgctctcggggttcgaaccagtacaagaaccttagatatatgatactgcacctaataaaaatagtctaaaataacaacagccaatataggcacaaacctgaaagtgtctgcatagaagtaacacatccatgtacttgataaactaaagtgtagatattttatgcggaataaactttgaagtgaggaatacca

SEQ ID NO: 408060 - DNA, 351 bp, Homo sapiens
tttgcttttctctctgatctgactaacctctttcattctttgccctatgttatatggcttagaccaaagcctgagacatttaaccaatttataaatattaaatgcagaaggcatactttatcagttcctggaaacatcaaagaagctggaaggggaatggaaattggatggcactttgtggaggtcactttgctgacagtcaagtattcaaaggatgaaggctcagatcagtttcatctatatgctatgcctgcctgacctggagaacttggtgttaaaggaaatgtgtttatcaaatgtgtcatgttatccttggagggcaactgaggatcagagcacagctgccttgaa

SEQ ID NO: 408061 - DNA, 2393 bp, Homo sapiens
aacagttctttgaaatgctatgttaagatatcactaacaatttcaatttataaatacacacccatacacattttcttttctaaattgtcatatcccaaacacgaaaacaatcgaataagagaacaggctgaatagtgatttttttctttcaattattactactgaaacaaatcaaaacaactctgagaggttgccagcaccgcagaaggcatttccacataaaaagagttaatgagcagaccacgcagttcaacagccagtgaccatttgcaagcctcctaggtatattcccagcagacacattatcagattaaaggaagtgcaaacaaactgggctgaaagtttctttgtccaaacccagcctcttcttcctgtgatgtcatattacaaatctaggaagcctttctttttcacttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagtta

SEQ ID NO: 408062 - DNA, 2481 bp, Homo sapiens
aacagttctttgaaatgctatgttaagatatcactaacaatttcaatttataaatacacacccatacacattttcttttctaaattgtcatatcccaaacacgaaaacaatcgaataagagaacaggctgaatagtgatttttttctttcaattattactactgaaacaaatcaaaacaactctgagaggttgccagcaccgcagaaggcatttccacataaaaagagttaatgagcagaccacgcagttcaacagccagtgaccatttgcaagcctcctaggtatattcccagcagacacattatcagattaaaggaagtgcaaacaaactgggctgaaagtttctttgtccaaacccagcctcttcttcctgtgatgtcatattacaaatctaggaagcctttctttttcacttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagttaaaaaaaaaaaaaaaaaaaaaaaaaaaaaaaaaaaaaaaaaaaaaaaaaaaaaaaaaaaaaaaaaaaaaaaaaaaaaaaccccgggggg

SEQ ID NO: 408063 - DNA, 2335 bp, Homo sapiens
aacagttctttgaaatgctatgttaagatatcactaacaatttcaatttataaatacacacccatacacattttcttttctaaattgtcatatcccaaacacgaaaacaatcgaataagagaacaggctgaatagtgatttttttctttcaattattactactgaaacaaatcaaaacaactctgagaggttgccagcaccgcagaaggcatttccacataaaaagagttaatgagcagaccacgcagttcaacagccagtgaccatttgcaagcctcctaggtatattcccagcagacacattatcagattaaaggaagtgcaaacaaactgggctgaaagtttctttgtccaaacccagcctcttcttcctgtgatgtcatattacaaatctaggaagcctttctttttcacttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgatttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagtta

SEQ ID NO: 408064 - DNA, 2178 bp, Homo sapiens
aacagttctttgaaatgctatgttaagatatcactaacaatttcaatttataaatacacacccatacacattttcttttctaaattgtcatatcccaaacacgaaaacaatcgaataagagaacaggctgaatagtgatttttttctttcaattattactactgaaacaaatcaaaacaactctgagaggttgccagcaccgcagaaggcatttccacataaaaagagttaatgagcagaccacgcagttcaacagccagtgaccatttgcaagcctcctaggtatattcccagcagacacattatcagattaaaggaagtgcaaacaaactgggctgaaagtttctttgtccaaacccagcctcttcttcctgtgatgtcatattacaaatctaggaagcctttctttttcacttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagtta

SEQ ID NO: 408065 - DNA, 2507 bp, Homo sapiens
aacagttctttgaaatgctatgttaagatatcactaacaatttcaatttataaatacacacccatacacattttcttttctaaattgtcatatcccaaacacgaaaacaatcgaataagagaacaggctgaatagtgatttttttctttcaattattactactgaaacaaatcaaaacaactctgagaggttgccagcaccgcagaaggcatttccacataaaaagagttaatgagcagaccacgcagttcaacagccagtgaccatttgcaagcctcctaggtatattcccagcagacacattatcagattaaaggaagtgcaaacaaactgggctgaaagtttctttgtccaaacccagcctcttcttcctgtgatgtcatattacaaatctaggaagcctttctttttcacttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagttatttagtgtctaaaagtgactgacttaaattatgtggtgccaatctgtaatgtctttgaattcctttttatattaaatgatttaatttactaaattattttatactaatttatgt

SEQ ID NO: 408066 - DNA, 2339 bp, Homo sapiens
aacagttctttgaaatgctatgttaagatatcactaacaatttcaatttataaatacacacccatacacattttcttttctaaattgtcatatcccaaacacgaaaacaatcgaataagagaacaggctgaatagtgatttttttctttcaattattactactgaaacaaatcaaaacaactctgagaggttgccagcaccgcagaaggcatttccacataaaaagagttaatgagcagaccacgcagttcaacagccagtgaccatttgcaagcctcctaggtatattcccagcagacacattatcagattaaaggaagtgcaaacaaactgggctgaaagtttctttgtccaaacccagcctcttcttcctgtgatgtcatattacaaatctaggaagcctttctttttcacttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttatataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagtta

SEQ ID NO: 408067 - DNA, 493 bp, Homo sapiens
taaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgaccaacaactctggtttgaaatgatgttcaccacgatgttaacaactctatttgctagtaacccctctatcttctagtaacgccg

SEQ ID NO: 408068 - DNA, 226 bp, Homo sapiens
cactgaacccacccctcgctgtcaaatgcttcaaaattcagtaggactgggatgtcgaaactcttatctctagaatgttaaagcagaaagtttaaaagctaaagaatgaaaggagttagagaataaactaaatcaagggcaatcaaaattcaatcccaggaatgaagtctaggcttaattaagactgtgatgaatattagatggttaagatttaacaaaacaaagg

SEQ ID NO: 408069 - DNA, 300 bp, Homo sapiens
gaaagtagtgggggttggatcctttgatggataaggtccttgattgcattaacatcctgtgataaaggtgtttcacatgtaacatctatgataaaggtatttcaactgcacatatctcagcaagggtgaactaaaacagcttttcactcttcaggtgcagaacagagggggcgaacctgtttggttgactgagtagtgattaggaagccagctgcaaacttgtatttcccccgaggatcaccgatgagcaccaccagccctgccaagagagcttctctttaaaacaaagctgttactttc

SEQ ID NO: 408070 - DNA, 616 bp, Homo sapiens
aaaaatacaaaaattagccaggcgtggtggcgggcgcctgtagtctcagctactcgggaggctgaggcaggagaatcgcttgaacccgggaggtggaggttgcagtgagccgaaattgtgccactgcactccagcctggtgacagagccagcctccgtctccaacaaaaacaaacaaaaaaagaattacttcttccagagattctctgccagaactcctaggtggtgttggacccatatcttttacttccatagcatcccaggctcagctcacttgtcctacttgttctgtgtcttcatcactagaatgtaagttctaagagggcagatgccaagctgttcagccattcacagaacctggcacagtgcaggcatatgacagatgttcctttattattatacttgggtgagtggatgggacctgcagcaagtgcagatcttctcagtgggctctggaacagaaaagtattgtttgtttgctcagcatatttttatttgtcccatgttgctgtggccaggatttgagctctgagacaatgcagcaaggtgagacccagatttcttttgttttgttttgttttttgagacagagtcttgctctgtcgcccaggctggag

SEQ ID NO: 408071 - DNA, 848 bp, Homo sapiens
aaaaatacaaaaattagccaggcgtggtggcgggcgcctgtagtctcagctactcgggaggctgaggcaggagaatcgcttgaacccgggaggtggaggttgcagtgagccgaaattgtgccactgcactccagcctggtgacagagccagcctccgtctccaacaaaaacaaacaaaaaaagaattacttcttccagagattctctgccagaactcctaggtggtgttggacccatatcttttacttccatagcatcccaggctcagctcacttgtcctacttgttctgtgtcttcatcactagaatgtaagttctaagagggcagatgccaagctgttcagccattcacagaacctggcacagtgcaggcatatgacagatgttcctttattattatacttgggtgagtggatgggacctgcagcaagtgcagatcttctcagtgggctctggaacagaaaagtattgtttgtttgctcagcatatttttatttgtcccatgttgctgtggccaggatttgagctctgagacaatgcagcaaggtgagacccagatttcttttgttttgttttgttttttgagactgtctcaaaaacaaacaaaaaaaagatgttaacatttgggaaatctgagggaatgatgtacatgaattctttgtattgtttttgcaacttttaagtataaagttatttcaggccaggcatggtagtgcatgcctgtatacccagctactcgaggctgaggtggaagattccttgagtctaggagtatgaggttacagtgagctatgatcatgccactgcactccaggctgggtggcagagtgacaccctatctcttaaaaa

SEQ ID NO: 408072 - DNA, 498 bp, Homo sapiens
acactttgggaggcccaggcaggtggatcacctaggtctggagttcgagaccagcctggacaacatggtgaaacccctctttattaaagtacaaaaattagccggacatagtggcacatgccggtaattccagctatttgggaggctgaggcacaggaatcccttgaacctggaggcagaggttgtagtgagcctacatcacaccactgcactccagcctggatgacagagtgagactgtctcaaaaacaaacaaaaaaaagatgttaacatttgggaaatctgagggaatgatgtacatgaattctttgtattgtttttgcaacttttaagtataaagttatttcaggccaggcatggtagtgcatgcctgtatacccagctactcgaggctgaggtggaagattccttgagtctaggagtatgaggttacagtgagctatgatcatgccactgcactccaggctgggtggcagagtgacaccctatctcttaaaaa

SEQ ID NO: 408073 - DNA, 406 bp, Homo sapiens
taacttacagaaggaaggttgggtggatcacagcaaaatgataaatgtgtgtgttacccaaacatgtcattgagaagaagcaatgcttttctttttcagctttataaggaagtggaatgaacattttggttagacagaaacatgttgtttaattttgtatttggcaggatagactgaatctcagtctgattatgtgatataagctattataatatccattaaaaagtcattctgctaatggcaacaaatgtgcgaatgccgcttcttttacaaatgatgaaatactactataatagttcttattatctcattaggtaggataccaagaagtttttgttttatgtattttaagaaatgtgttgctaatttaagatcactctcccctggatgtgagtaaaaattccga

SEQ ID NO: 408074 - DNA, 349 bp, Homo sapiens
ggcctttacagtacttgtcagaactcctatgcctcctgtactttctaacttcttataaattacccagtctcagatatttctttagagcagtgcaagaatagcctaacagaaaattgatactgaggagtgcggcattgctataaagatacctgaaaatgtagaagtgatttttgaaccgggcaacaggcagaggctggaagagtttggagggctcagaagaagatgggaagataagagaaagtttggaacttcttagagactggttaaatggttgtgaccaaaatgctgatggttacatggacagtaaagtccaggctgccaaagtctcaggtggaaatgagaaacttat

SEQ ID NO: 408075 - DNA, 421 bp, Homo sapiens
cagcaatttgggaggccaaaacaaaaggatcacttgagcccagggattccagaccagcctgggcaacataacaacaccctgtctctacaaaaagtaaaataataataataaacaattgctaggtgtagcggcacctgcctgtagtcctagctactcaagaggctgaggtgggaggattgctttgagcccaggtggttgaggctgcagtgagtggtgattgtgccactgcactccagcctgggtgacaggtcaaggccctctctcaaaacaatagaaaaaaccttcaggtctaaatatgaattctattataacatttaaggaaaatgtattctcggttttatgtcaacactggcagaaagtacaaaaaagcatttagtatcttatgtcctgagatgaactttgacctcgtgccaaaaccaga

SEQ ID NO: 408076 - DNA, 317 bp, Homo sapiens
gtgtctcataacctctagtctctcaactcttcttctctcagtgacccattgcatttggactcactgccatcccaatacaaacccaacccagtgctagccatttcactctgccctaaccagcactcctcaccctccacccgccacacctttgctaggtctgcctgcctggccccaccttgattacacctttcattttttccctcaccaggtactgtgtactgctatagaaagccatagtacattgtgaaaccattatgcattccttttaacctcagccatggcttcactacgtatgtgtagatgtccccatcagcacc

SEQ ID NO: 408077 - DNA, 821 bp, Homo sapiens
aaatccaggttattttgttctgctcacgagttgagcctgtaagcctttctgtttgcctttctgcagaaagctgtttgtgagaaccctgtcttgagtacatgactggactgcacatgcagcaggcctgggccttcaactccaactacatctggaggaggggtcccagtgtgaaggggttggataatagtcatagtggttctgtacaatcagaataaatcctggctcctgaagagaagaggggcaggcagcagggctcacactgtgcgtgctgggtgttgtgattctgccatctgtcctcaacttcttggggaggggctgatggaacttgtagagaaggtggacctttagggggcttcatgggccttctcacagtgagaatccagccctgtccagaagcagcctcaagctccgcactttcagtccagtgctgtctcccaaagccccctccgccaaatgaatcccacagccagcttcagcctcagatgctgcccactgccccctccgtagaagtcctttcacctgtgtctctactaggtctgaccaatgtttcttggattttattggctaagctggataaagacaggccatttaaagtaggaaagtgggatcctgggtgatgtagcaagaccccatctctatgaaaaaaataagaaaattagccaggtatggtggtatatgcctgtagtcccacctacttgggagactgaggttgaaggatcccatgagcccaggagttggaggctgtagcgatggagtgagccattatcacaccactgcactacagcatgggtgcagagcgagaccccgtgtccaattgaaaa

SEQ ID NO: 408078 - DNA, 539 bp, Homo sapiens
tatcttctattacaatcaatttttaataaaataaagataggtttaacaccaaaaatgtagcaaagaaaagctctgaattgagcacattctgtatttcttctcatcttgccataaacaagtgaaaacctccccaggactggcccagttctgaggacccctatttaggaatcctactatgggcaactccaggcagggtgggatggaaggccatgtctctgtcctcaacaactgcctatgcccacccgcaccacgtaccagaacacagggctgctgcactctctgccagggttcctggggcaggatgcccccaagggcctccaaggcattttgagtgaactggtcaacggacatgtgtcacccaggaggttaacccatgctcctgcccaggacttaaggtcctactgctccctggtttaagctcttgttgccaaccttctggctcaaaacagaactcaggaagaaaaacattttgaaaaaaggtagatggggcagggtgcggtggctcacgcctgtaatcccagcactttgggaggccgaag

SEQ ID NO: 408079 - DNA, 1287 bp, Homo sapiens
ggagcctgggctcaggtgtgtcctgtgggaagtgattgctccctggctagcagagacagaggaaagcggattgttggccccaggacccagctctgagaggctgggcttgtttccctgactctgccttggaggaaagcaatggaaggggaaggggtaagaaacttcaaggaacttcgagccaaatttcaaaatcttgatgctccacctcttccaggacctattaaattcccagcaggtgtttctccaaagggtgacattggaggcacacagtcaactcaaattttggccaatgggaaacccctctcatccaaccacaagcagcgcacaccatactgttccagtagtgagtcccagcctcttcaacctcagaaaataaagttggctcagaagagtgaaattccaaaatgttctaactccccagggcctctgggaaagtctactgtatgttctgcaacaagttcacagaaggcttctctgctgttagaggtgactcaatcaaatgttgagataatcactaaggaaaaagtaatggtggccaatagcttcagaaacaaactctggaactgggagaaggtttcatctcagaaaagtgaaatgtcttcagcccttctccttgccaactatggaagtaaggccatccatctggaagggcaaaaaggcatggggcttactccagaggaacccaggaaaaagctggaaacaaaaggagcccagactcttccttcccagaagcacgtggtggcccccaaaatattacataacgtctctgaagatccctcttttgtaatttctcaacatatcagaaaaagctgggaaaacccacctcctgagaggagcccggcaagcagcccctgccagcccatctatgagtgtgagcttgccagtcaggccccagaaaaacagccagatgtcaggcatcaccaccttcccaaaacaaagccattgccctccatcgactccctgggtcctcctcccccaaagccttcaagacctcccatcgtgaacctccaggcctttcagaggcagccagctgctgttcccaagactcagggggaagtgactgtggaagagggctccctgtctccagagaggcttttcaatgcagaatttgaagaaccacataattacgaggcaacaatttcatatctgagacactctggcaactccattaacctgtgcactgcaaaagaaattgctgatccaacttatgaagttggaattgaagaactccaaaagcctgggaagaattttccctatccagaacctagtgctaaacatgaagataaa

SEQ ID NO: 408080 - DNA, 1233 bp, Homo sapiens
ggagcctgggctcaggtgtgtcctgtgggaagtgattgctccctggctagcagagacagaggaaagcggattgttggccccaggacccagctctgagaggctgggcttgtttccctgactctgccttggaggaaagcaatggaaggggaaggggtaagaaacttcaaggaacttcgagccaaatttcaaaatcttgatgctccacctcttccaggacctattaaattcccagcaggtgtttctccaaagggtgacattggaggcacacagtcaactcaaattttggccaatgggaaacccctctcatccaaccacaagcagcgcacaccatactgttccagtagtgagtcccagcctcttcaacctcagaaaataaagttggctcagaagagtgaaattccaagttcacagaaggcttctctgctgttagaggtgactcaatcaaatgttgagataatcactaaggaaaaagtaatggtggccaatagcttcagaaacaaactctggaactgggagaaggtttcatctcagaaaagtgaaatgtcttcagcccttctccttgccaactatggaagtaaggccatccatctggaagggcaaaaaggcatggggcttactccagaggaacccaggaaaaagctggaaacaaaaggagcccagactcttccttcccagaagcacgtggtggcccccaaaatattacataacgtctctgaagatccctcttttgtaatttctcaacatatcagaaaaagctgggaaaacccacctcctgagaggagcccggcaagcagcccctgccagcccatctatgagtgtgagcttgccagtcaggccccagaaaaacagccagatgtcaggcatcaccaccttcccaaaacaaagccattgccctccatcgactccctgggtcctcctcccccaaagccttcaagacctcccatcgtgaacctccaggcctttcagaggcagccagctgctgttcccaagactcagggggaagtgactgtggaagagggctccctgtctccagagaggcttttcaatgcagaatttgaagaaccacataattacgaggcaacaatttcatatctgagacactctggcaactccattaacctgtgcactgcaaaagaaattgctgatccaacttatgaagttggaattgaagaactccaaaagcctgggaagaattttccctatccagaacctagtgctaaacatgaagataaa

SEQ ID NO: 408081 - DNA, 887 bp, Homo sapiens
cccagtgaccctaacatgtgcagtctggggacatgggaggacatgagcgcagccagagaaaacccatgcagacctgccgagaaggtgtaatctgcacagacagtagccccggcctgggataataagatgacgctgaacgaaagtcgttggaggacctgccattatcagcctgtaggctgaaaacagatgggaatctcagcaatcagactcgctctaacagcccacgctcagaggctccggctgtccatgctctgtcaggctttccctgcctcatcacgcctctccatgaagctcctgagtgaatgaatactgttattcttatccccgttttacagatgagaagccatagcctgtaagcactgatttgctggaggccacagttgaatccgcacagtgtcatgtaattgttttggggggttgtgttgttgttgttgttgttgttgttgttgttgttgttgttttgagacatggtcttgctctgtcacccaggttggagtgcattagtgcaatcatagttcactgcagcctcgatttcccaggctcaagcagtcctcctgcctcagcctcccaagtagctaggactacaagaacgctctaccatgcctggataatttttaaaactttttgtagagacagacagggtctcgctttgttgctgaggctggtctcacattcctgggctcaagtgatcctcccacctcggcctcccaaagtgctgggattacagatgcgagtcacggtacccataattgtttaaattgacacaaaagatggagaaaaatgtgtctttaatctgttgagtacaaagtgcatacataaacatagaagggcaatgtatctgattttcttcaaacatttaagaaattttgttacgtttatccaaaaag

SEQ ID NO: 408082 - DNA, 919 bp, Homo sapiens
tattgcttttggtttttttggcgaacaccgtctctggaagacacaaggaggaaagtaatcgcacctccaagacaggaggtgggattactttcctccttgtgtcattcaggacgactgctccgctctttcttgtaagccctttcttttttgaaatcacatcatcagtcttcactacctcatcttcctcttggcaaccttcagctccccttccctgtatccctctccctgcacgtgaagaccagcagccagttcctggtctgtctgtctgtctccatacaatcattattccctgtattttctctccatccacagacaccactcctgtttttacatcctttatccaatccctggcctggcattatagtcactcactcatgaatacccttaactgctcactccttcattcttccatcagtctcaaacttagaggaactctgcctccaccttccctatgcctgcgcatgagcaccttaccatggctggtgaacgtcccataccaagggcacagttaacatgcgtctgctggtcagggccagctgagcatcctacactgggcagaagggttgctgtttctctgataacttctcctcccttatcctcagtgattccttcctgtcttcaccactgtattcacatgtcccacgctcctgctgcagctgacactacttctgaatgtccctcttctctataccaccagggctctagatctgatcaccatgacttttagttttatttcctctaattcattgtccaagctatagcctgcatgatctttcaaaaatggacagtgtggctcacacctgtaatcgcagcactttgggaggccgaggtgggcagagatcaggagttcgagaccagcctggccaacatggtgaaaccccgtctctactaaaaatacaaaatattagccgggcatggt

SEQ ID NO: 408083 - DNA, 471 bp, Homo sapiens
ccttttataatatttcccaacttagtctctatcttttcttcaattttaatttggagatttcttaaagtattcttgtgagcactgaggattttatggcaattaccatgtactatgaacactgaacacttctagattgacctcagttttattgacatcaattcctttggctctttctttacatccaggatcagtagatcagaaatgattgaaaataacagaatccttcatattcacaaaatactgtaaaagcaaaacctgcaggaagagatgtccctatttaataagaatggaattggagataatagaagatggcaaaaaggccttctgtggagggcaacggacacaaacttatcaccaaagtcagtatgaatcggtagcccctaaacaggcagctcaggacattggttagacacctctgcatgaaagtatttttaggacaattaaatctgtcaatgattgaatttataaaaa

SEQ ID NO: 408084 - DNA, 427 bp, Homo sapiens
tcaggaggaaggtaatgagttttaagtaacaaaacaggaaattagctcctctgtgacctttgatgagtttgtgaagctggcgttgtgagtgcaggattgaaattgtgaagagcattatatttagtttgctttgttgcttttgcagagtatctatttgccaggaaaacctaggaattgaagttaaagactctgctacctttgtgggaaatgaacaatactcttccttctgctggcaaaatctgggtgtctacttttcagtggctggtttttgctttcacgtagggtcagagtatccttttcctggaaccaagcttgactcaaagccattgtaagttctcttgttctttatccttctaatcaactattttaggagcaattttaaagttgacaccctttcccttctaacctttctgctcaatacaaagca

SEQ ID NO: 408085 - DNA, 526 bp, Homo sapiens
tcatttctgaatctgaggatttttagctgttacttcctccagcaacccccagtttctagagtctgtagctaggcagagacattttcttgttattcctttgctgttggttgatttttttttttaaccagcctcccctgtccattcttgcactgagaatgtgtaaaaaatggtgaaaccctcaataccagctctgcgcttcatgcagacaaggtttctgaggccttgtctactttaagggcattaaaagccaaaaatcttagttactcatattgacaggttcctccagggttgctgaaagctttactcttttgtgagctcagcatttgacagactaatttatccagcatttctagatgttttattaagatgacattttcatattagttactgtgttgccaaaaaaaaagaaagttgcatttcttttttataattaatttatttcccttttctcctctttttcctttggaattccatgtagttggacctcctggatggaagaactcttctcaagcttttctactttaaa

SEQ ID NO: 408086 - DNA, 644 bp, Homo sapiens
atacactttcctaaaagaggatctagaagtgtttttaatacctgacaagctattctctctccacagctttttattccagggttcttctagttgttcttatgtttaatttttttcatatggactttggtatcaacttttcaagctccatttaaaaaagaaagcttgtggaatttttataggattgcactaaattgatggtgttgctaagattcaaacataggcagtttgctccaacacctacatgaagtttggggcgaaaaagaaaaaagtaacatttttgtagtggtattcagtttttattaatagagttcggttttgttgttataactaggctactttgtattaacccctggaattgaaacttattatgaaaataatttgcatgtaggtttactaacaaagaatcaggctcaaatgcactaaaagacagacatgaaaattgtgtttagactactctgaaaattcttatccctataatagaaaataattcatctgtgaaatgaaataataatctagaaaccctctgatggcatgtagaacttgttctcagtggaaaactcagtcaactaattctcaaatgtttgcatacttaaattataccccaagtcataaataacaacctattaaataaatttgctttgtgt

SEQ ID NO: 408087 - DNA, 614 bp, Homo sapiens
agggtgcactcccagagactgtgtcaggctgagtcccctgcctcctgggaattctgtcccacctccccagtccctacccaggggctggtcagcagcattcatgcttgggagcagagccaggttctctgtgccttgctcccctggtaaccacagattccggacaccatgcactctctggataggagaaaaattaatgaccctgaattctgtggtgtgggctaccaggccccaaagggatgttttgtggtgataatccataatataaggtctgtccagaaaagctgtgtgcatgtgtgcatgcgtgttggcaacggggctgcttccaatagcaattcctggaaaaagttctgcttttcccccgctccctggccccgtgctgagggccatcaagttcagaagagcgcagagcgacagagattaagacccaggaacagctctctttgtgtcctagagagaggaaaggtatctactggcaccccgtcagtagctgaactgaagccagagcatgaacatcctgcctcccagttctggcttgagtgtgggacctcttttcccatcactgcctctctccgagggctgttactactaatttggggtcagcctgaaaaaaaaaa

SEQ ID NO: 408088 - DNA, 560 bp, Homo sapiens
tgatagaagactttacctatcaggccttgctgcgataaagcaaaccccaattacaaaccatccggaccaaacggggaggttgtgggaagcataaacaaactttacctacaccctccagtaccgtaaacatcacaaggtgatatgtggcagaattaaccagcagacaaccccgggatgcagccataccaaaggactccctcaaactccctgccccaatgtaaaccccctattctgtaagcttggggctgctttccttgactgttaagggggcagccgacaggttaataaaggcttgcctgaacttggggctctctctctctggtcctttctctcggctaaccttacattctcactctctaagttcacatgagatctggttgctttaaaaagcctggcagctctttgttctctctcgccatgtgatatgctgattacccttttgccttctgccatgactgcaagcttcctgagcccttaccagaagcagatgccagtgccatgcctcctgtacgccctgcagaagcatgagccaaaataaacatttttctttataaattacc

SEQ ID NO: 408089 - DNA, 370 bp, Homo sapiens
agtggctcagtgtggtggggtgtgagagggagaaatgaccctgctggggaggagggaggaacacaccacggccaccctccaggccatgcaacagcacttggactttatcctgaggcaatgggcggtctccaaaggccaatcacatggagaggccatccagtactccaagtgtttccagacacatcccttccttgcacaaaccgaaaattggcattcatgcaggacaaataaacataatccctacaacggctattccagagcaccatgtctggactctaaggcaaaaaaataaaagctatcagcccattacatatggtccacagtaacatccttctatgaacacacacacacacacacacacacacacacc

SEQ ID NO: 408090 - DNA, 390 bp, Homo sapiens
tcctggctattctttcttgtttatttctacagatgaacccaatattatcttgtaaaatgttgaaaagaaatttttaaatttagcaagaattaataccccttaatagagattttatattttctttatatggtcctgcctatttctagttaagtttattttcagataaattgatgatagtattgctatttaaatgggatcttttctttcactgtattttctaactagccattttgtacagtaattatacaaaaagtaactactaaaattgtcttataatttctgttagcttttctggcaaaacaaaccacccaatacttagtgtcttaaaataagaaacgttatttctcaactctgtgggccaactcggtttatttctgcagaaacctggca

SEQ ID NO: 408091 - DNA, 163 bp, Homo sapiens
tttacctccatcttctaaaactattaattaatccagagaagtgtgttgctataaaatattctgtgaagcattttcacttatttttcttttctttcaaagaaaacaatatggcccagttcctggcttttgaagaactagagaaaatcatcatcattggtgcctc

SEQ ID NO: 408092 - DNA, 1135 bp, Homo sapiens
gagagcccttgattttcctgttagatttattgccagtacttctaactggtgggtcgggctttctgcctgagtttgtggtgaggtattgctgagaagaacacaggaatcattcattgctttcccttgcttggagatatggtacactagtggcaggccagtggcccagcctcacgtcatctcacatccactgtgcagtagacagaaaggcaacatttgaataggaagttctgttacattttctgccaggtgaatgaggctgagagcaacttgtagtcctgggttgaatcttcaaagctgtcccagctgccatgagaagacatttagttgagatctgtgcatattcacatatcccacccatatttagctataagtgatgttaattttttattgttaatattctttaaaactaagcaaataatacagcttaaagttctcatgaaaaattgttaataaaggtgatgaaaatgatgaaaaaagtaaccttacataaaagaaagggtataatacttcagatttttaatactcatttcttaaatactcttttagaagtgaagaaatactaaatttttgtttaccagtgatttgaggaagattattcagttggtgaaaagttttcagaaaaaagaaattcactctttttgagacttacggcttaaatcagttaaaattcatttgtacaggcacaatgtatcatctgcagtctgaagctttctctaccactagaaagtgggtataggtctacattgtattattctatggttgccttcttggaatatcttctattaattacattttcttttttaaagcactttaacttacaatagaatttcagaggtacatttccacagcaataatttactctaagacataatgatcatacttatgaatgcagaaaaaattaaatactgttgatagaaaaatcatgctttggggacaaataatagtaatttgtaaattatttctacattggcaagtgtcatattgtcggcttctagtataataaagtgatacattcaagcatgccaaagaagaaaagttgatttacaaagaaccacgtgggagaaatggttctttctgatagttcacatctcatgaaagtatgtaagattgaaacccgtttctgcgtgtcatttaa

SEQ ID NO: 408093 - DNA, 411 bp, Homo sapiens
tttaactttgaggaccctagggtccatttgctcatccagtttctgtgtagccaacattaaaacacagctttggaaataaatagattgccagtagcctcttagctgttatccatttaaaaatgggattccagtctttaaaagtcttattaggataaaagatttatttttctttgatcattggttgaaagtcattatttatttccaacactggattgtcacataaattcctaaggaagagttaccttgtgtgtactcagtgcagtcagagtagactttttaaaatgacaaattattaaagagatattcagtaataaaagaaagcctataagaatacctataagggtaggcacatcaccactgagagaaaaaaaaaaatcaagggagtttatgttaaagtgagccctatttaag

SEQ ID NO: 408094 - DNA, 400 bp, Homo sapiens
ggtgatatagacaggataattatagacaatgttcaaattcttggttaattgtaagcttgaaattgttcattttttaaagaggaaatgaaataagtttactccaaataatgatagcttagatgactaactaatgataggtgaaaagcaaggattgatagttaaaatgcctctcttttgttattatcttctttgctctgtacttagaatggacgtacttgttctgatttgaggacttcttcatggtcacatgttctgtttgcaccatgcttagggaaggagcatgtgtaccaatgtgagtgacagtcagatttcttggcatttctttggggtgggtttattttaaggagggactccaatgttactgtggaattaaacatgtaatataatcaaagatggtgaa

SEQ ID NO: 408095 - DNA, 400 bp, Homo sapiens
ctgttggggagagaatagggcccaaggagaagcctaaagaagagtacagctatgccttccagtgattcacttcactgttatttgattcattaaggttttactggggaaatgccttatcattgaggcttctgggaaaaaaaacattcaggtgattgatgaaatttcaaaaagtaaaagaagaataagatgaagacaatgacaccaggttttgcatccttgcttgcaggaggtctaaggtttcaactcacacactggatcttactgattgaaagcagcaaatatgccatgattgactaatgatgtctgccatgggtgtggaatagacaaatgaagacaaaaattcaaatacctcactgagcagcagagtcttaatccatcaggaaagcctatgaaaaaaaaa

SEQ ID NO: 408096 - DNA, 461 bp, Homo sapiens
aacacattcaaatggtcagtttctgctgttcggctgccagttgcgacttctgctttaatcaatctgaaggccaaactcatccagacccttaggcttcttcctttggaagtcctgtattttcttactttcttaaaatatactccatggagttgacatcagttatgttatggtgctagtatcctaagattgtcactactaataatttagtccagattttattctttctgtcaactaattttatcatgagtacctcatttcagtgtggttaactaaaatatccaaatttttttttggatatttgctatgcttaaaacatagcaaatttttttcctggtagtataaaatttacttgtttttgttatttttaaacttttgcatggcttttgcatatttttaagtaaatatatttacctttgaagaaataagagtttttaatgagtgaactctaaactatttaattt

SEQ ID NO: 408097 - DNA, 300 bp, Homo sapiens
atgaatttttgaaatcatgcaacaaaggtgcatcccattatatcagggtgtatgtgacatctagatgacattacagtgacattaacctttatcagtttggtaagggggctttcgccaggattcttcttagtaaacctatcacttttcctgcttttttctctattctttggaaataagctacaaagcctagaatgccctagcaggtagaaggaattaaacttcacttcttgtactggggagtatctacatatgttatttgaaattcttctgtaagaaacagttgtttcttttcctcattta

SEQ ID NO: 408098 - DNA, 538 bp, Homo sapiens
tctatccaatgagtgaaggctctggccagctcagtattactggagcatagaacactggtcctaaacctgaaattacacattgaaattatctgggagctttaaaaagtactgattcttgggccccagatgggtctccatcccagagtttctgacttaatcagattggggtgcaacctggctgggcattggggtttttagagctccccaatgacgatggtgggagctggggttgacgcccactggtgtagacagagcattgattgactttcctgattgccctgttttgcctgcagagttctttaacaatgccttttcctggccttcactctgaggttctaatatgattggtctggagtggaggccctggcattgtgggttttaaaactccctgaactattctgacgtgaggccagggatacaaacccctggtgcatgggtgtccaaccttttggcttccctgggccacattggaagaagaagaattgtcttaggccacacataaaatacattaacactaacgatagctgatgagcggaaa

SEQ ID NO: 408099 - DNA, 428 bp, Homo sapiens
ttgtagccctgggcacaaggcagctgaagaaatcagtgctggattggttccaagtaaaaggatggcgtatgtatctagctcactttctctgataaacagtaccttttactggatattctccaagtgtggcaaagttttaaaggttactgttatgaaagaaaaagaagaggccaggtgtggtggctcacacctgtaatcccaacactttgtggggctgaggcgggtggattacttgaggtcaggaattcaagatcagcctgaccaatatggtgaaaccctgtctctactaaaaaatacaaaaaattagctggacatggttgtgtgcacctgtagtcccagctactcaggaagctgaggcaagagaatagcttgaactcgagattatgccaccgtactccagcctaggtgacagagcaagactcaatctc

SEQ ID NO: 408100 - DNA, 355 bp, Homo sapiens
ccttatcagtatatttacaaatgttttctttcattctgtgggttgggttgtcttttcactttcttcgttctttcttttgtctttctttgtcatcatatttcatgatttcttgtgaacaaagtattgtctagaggacaagcattgtaagtattaacatcggaatcagtgaaaacaatcagtatagatcaagtttttaagtgatactttctcagaaatgtatgtgtacaggtcattgaagattatctataagcaattggtcttggaaaagcataatttttgaagaactctcttgccctgtgagagtgatctaatatgaatgaataaaatatatttctgtagttgaactgaaaatagg

SEQ ID NO: 408101 - DNA, 162 bp, Homo sapiens
gcttgagtaccaaaaggctatgaagcatgcttaataactatatgcttgaaacaacaacttgtacaaacaaatgtaaatgtgttaatttgtgtttgggatttcaataatcacctcatgtataatagctgtaggaaactacttggccctctatctggtttcttt

SEQ ID NO: 408102 - DNA, 414 bp, Homo sapiens
ctgatcgcaaactcctgggctcaagcaattctcccaccttggcttcccaaagtatcaggattataggtgtgagccaccacacccagctgacattgggcatttatggtacaaaacctccctcaggtacaacgctccaaaagagccagtttccagcattgaattcatcgtggacttacccatgtgtggttctggcaccctgcccggggctggaggctgttcttggccttggtcctttagaataggagtaaatttggcaacataggaggacacccaggatacattgttaagttaaaaaaaaagagattctaaaatagaatgtatgtatggttctatttttgttaaaagttatgttctctaagtctttttaaaaagtttgaactgtcacagccaagaagggtctaaagagacatgaca

SEQ ID NO: 408103 - DNA, 699 bp, Homo sapiens
tcccaggaccagtcttaatacttctctctgttctcacacttccctgctagttttctacccttataattttgcaaaaagtcaaaagaagaaaaagtactaaaacttacaccatttgatttttctctttgctactgctagtttgaaagggccctctgcatagcctgttttcacatttcctttgcattgctttattttctttcactgttggcgtgatgatctgatttgaggaggtgccgccgtgggctttcctgatagtagttcatcttttacagtttctgtctctcagggtgtgagtctctctttgacactgaacacagcagccattccactgaactgacttgcttccaagagaccatcctcacttcactaagacagtagctcattcctggagagatttcctgccttgatggtttttaggcaaatctttagtcctagggagttttattgagaccctgacagaagtattaagacacaaaaacacattcacttgagactagcctgggcagcatagggagactgtgtctctacaacaaatttaaaaataagctgggtgtggtggggcatacctgtagtcccagctacttgggaggctgaggtgggaggatctcttgatcctgagaggttgatgctgcggtaagccatgattgcaccactacactccagccctgggtgacagagcacgaccctgtcttaaaaaag

SEQ ID NO: 408104 - DNA, 778 bp, Homo sapiens
gggccgcctactactactactgctcgaattcaagcttctaacgatgtacggggacatgatatatatagtttaaatctgattgtatgaccccaaatcccccttctctctgttctcacacttccctgctagttttctacccttataattttgcaaaaagtcaaaagaagaaaaagtactaaaacttacaccatttgatttttctctttgctactgctagtttgaaagggccctctgcatagcctgttttcacatttcctttgcattgctttattttctttcactgttggcgtgatgatctgatttgaggaggtgccgccgtgggctttcctgatagtagttcatcttttacagtttctgtctctcagggtgtgagtctctctttgacactgaacacagcagccattccactgaactgacttgcttccaagagaccatcctcacttcactaagacagtagctcattcctggagagatttcctgccttgatggtttttaggcaaatctttagtcctagggagttttattgagaccctgacagaagtattaagacacaaaaacacattcacttgagactagcctgggcagcatagggagactgtgtctctacaacaaatttaaaaataagctgggtgtggtggggcatacctgtagtcccagctacttgggaggctgaggtgggaggatctcttgatcctgagaggttgatgctgcggtaagccatgattgcaccactacactccagccctgggtgacagagcacgaccctgtcttaaaaaag

SEQ ID NO: 408105 - DNA, 1780 bp, Homo sapiens
aagcattaactgtaaagttgtcatcagtactgtactttatagtacagtaaattgtcatcaatacagtgatatagaaacatgccacagggatgactggggtgagaggtgagaatcaggaaaaccttcccaaataagtgacagaaatagaatggggaacactatgactgtcaggcaataggccaggaattattcttacatgttattttatttgaaaagctcatagagccatttctcactccattttctactgcttataacagaatacctgaaactgggtaatttatagacaaacaaacttttttttttttttactgttctggaggctgtagagttcaatgtcagggggacatctgacgagtgccttcttactggtggggcctcttgccgtcctgaggcggcaaagggaatcacatggtgaggcggctaagtgtgttcactggggtctctcttctctttataaaaccaccagtcccactcccatgatgacccattcattcattcactcattaatccattaattcatgagggctctcatgacccaactaccttttaaagactctgcctctcaatactgccgcattggggattaaatttcaacatgacttttagaggggacattcaaaccacagcagccacattaaggaaatttttgaaaaatttaatttttagacagctctgtacatttcttgcttattattcatccagttggaatcacagaatacatgaaacacaattacaatcttcttgtctcttatcttctattttttccactttgtattaaatcaaatgcatcatctcaattccaaacccttttgtttatactctgatatttactccagtgaattcttcatgtataaagttgtttttcacagccacacacttgtaccacaaatctagggggtattctttcttttagtgtccttaatattgtattactttctaatattcacactttaactttacaaatgagtagaatggaatagctgtgtttcagtacagaacttttttcttatgtttgcttgggccttcctcctctctgttacctatgttgataatctaggatttgttgtctcacatttttcccgatgttcatatgatattcaatgaaataaaatacatgtgacacaaaaaaaagttgttttccagatacccaaatataatggggagtggcgagttagagagacagacattttcatgagctttgcttcacaggctctggttcttggctgaaaggtaccagccgcctacagcaccctgtatcccattcaacagaccctaaaagaatctctagtcaaattaacaggtctcctttcctaattcctgaccaggagttggggattaggcccttgtcttactattttacatattctctcacctccaagccatggaggtttatatttcttcttttcaggttcgctaaaagtaactcttccagctgctagttctggctaagtaagcacactccaccctatttctcccactgatcataactagcaaccctgggcagaatcgtaatgaaaacatgtaaggactctgaaaaataaattatatcaggcaaattgaagagagaaaccaaaacccaaagtatagttaatatggcagtgagtatctcctggcttatactccaggacagggcagttttagaaactgtgcaatggacatggactgaaaaagctgcaggagacatctcctgcctcgatcccttcccagagtgacaggaaaggggtggcccttgggggaaaaaaatgtgatcaaactgatgaaaatcaaatataaagga

SEQ ID NO: 408106 - DNA, 1153 bp, Homo sapiens
tcatatccttcactcccccaacataagcaatttaatttttagacagctctgtacatttcttgcttattattcatccagttggaatcacagaatacatgaaacacaattacaatcttcttgtctcttatcttctattttttccactttgtattaaatcaaatgcatcatctcaattccaaacccttttgtttatactctgatatttactccagtgaattcttcatgtataaagttgtttttcacagccacacacttgtaccacaaatctagggggtattctttcttttagtgtccttaatattgtattactttctaatattcacactttaactttacaaatgagtagaatggaatagctgtgtttcagtacagaacttttttcttatgtttgcttgggccttcctcctctctgttacctatgttgataatctaggatttgttgtctcacatttttcccgatgttcatatgatattcaatgaaataaaatacatgtgacacaaaaaaaagttgttttccagatacccaaatataatggggagtggcgagttagagagacagacattttcatgagctttgcttcacaggctctggttcttggctgaaaggtaccagccgcctacagcaccctgtatcccattcaacagaccctaaaagaatctctagtcaaattaacaggtctcctttcctaattcctgaccaggagttggggattaggcccttgtcttactattttacatattctctcacctccaagccatggaggtttatatttcttcttttcaggttcgctaaaagtaactcttccagctgctagttctggctaagtaagcacactccaccctatttctcccactgatcataactagcaaccctgggcagaatcgtaatgaaaacatgtaaggactctgaaaaataaattatatcaggcaaattgaagagagaaaccaaaacccaaagtatagttaatatggcagtgagtatctcctggcttatactccaggacagggcagttttagaaactgtgcaatggacatggactgaaaaagctgcaggagacatctcctgcctcgatcccttcccagagtgacaggaaaggggtggcccttgggggaaaaaaatgtgatcaaactgatgaaaatcaaatataaagga

SEQ ID NO: 408107 - DNA, 778 bp, Homo sapiens
ggagtgagactctgcctcaaaaaaaaaaaaaaaaaattcttagagcacagtataatggtcttagatagtgatcgaatttacactgttatcaattgatcatttacttgttctggactattttacttcttagcttatggccgagctttttagtatttttagtttccttcatgttactttagttgtaaaatagttagtcattccctaattggcacactttaacttagtccaaatatcatttattaataaaatgacttcatagaaattattgttggccgggcgtggcagctcatgcctgtaatcccagcactttgggaggccgaggcaggtagagcacctgggctcaggagttcgagaccagcctgggcaacatggtgaaaccctgtctttgccaaaaaaaaatatcaaaaaaattagccaggtgtggtggcatacacctgtggttccagctactcgggaggccgaggccggaggatcaacttgagcctgggaggcagaggttgcagtgagctgagatcacaccactgcacttcagcctgggtaacagagtgagaccctgtctctcacacagacacaagtttgaaaaagaaagagagagagaaaatacttaaaaaaagaaattattatccaaatgtacttttgagcacattgtaaaatatttgacattttaagaagtgcatgcttttatatgaatctaaaattgtattataaataagctgtttacagttctacgtacatttccatttttttcgtcttttttcactaaggttgtcactctgta

SEQ ID NO: 408108 - DNA, 295 bp, Homo sapiens
aataatcagctgaaggaaatggcatttaagagcatcgaacaataataaatgtttgattaaataaaaaccgtgacaagagagtagggaggagaaggtcctatgtcgctcactgatgcacttaacaaacatttgtcaactcctaggagttgcattctgtacaaaatgcacaacaattcttacttaagttcataatatagtaattcatttgagctgaatttccttccagtcctaaagacacagccaaaactattcgaaaagtgggggaaggtgttttgttttgtactttaacaaaaag

SEQ ID NO: 408109 - DNA, 587 bp, Homo sapiens
tctttgtactgtgtcacactgataagtgaattttttataagcgtaattgattttattaagtacacagtattactcaagactttcgcttctgtgtcaagtgagtgaaactgaacccacagtggcttaaacatacaagcaaatgaaatggcatctgttggctcatgaaactgaaatccaggcacagctggatctgtggcctgaagttaccatcattctcataccccaccccacccccagcctccactttttcagtcaggccatccttcccgcatggaagcaaggtgcccccgcagctctgggctgccaccctgacctctcagctgaccagacagaaaaggggcttctcttcctcctacgtttcaaggggtgaggtcaacttcatctaaactctgtaacctagaaggaaggggatgagaggataccccaggggaaagccagggctagtaacaatagaaatggcaatagaggccgggtgcagtggctcacacctgtaatcccaacactttgggaggccaaggtgagtggatcaactgaagtctggagttcgagaccggcctaaccaacatggaaaaaccctgtctctacta

SEQ ID NO: 408110 - DNA, 212 bp, Homo sapiens
caaaagcaatttctactaatactttgggagtattaatctccagggtatatgtctttgtttttgtttcagtttcaatgcatgctctttcagtatgcttcatgtatttacggtctatttatggtatatatccagatttgtataatactctttcttaatatgctatattgcaagtatatctccatgttataataaatactttgttaacattattt

SEQ ID NO: 408111 - DNA, 634 bp, Homo sapiens
agacggtgtgcacaaatgggaggggatgggctgaaaggaactggatcctgaaacacaggaatgagcaaaggcagccacagccctcatactgggagttcacagtggtggggagaagctatcaccccacagacacagctgcagggagcccaggacagaaggcagtggggcaatgaggacttcgctctgggggccttctagtctgggagacatggaaaaaggcaggggccccaagacccaccaggggaagaggagtcatcaggctcagggcagagggcagagacagcaacacagcagaacaagccacggtacccacaggcctgggtgggggccgagaaaagccagtgggttgagggaggaaggagagggctgtcacacccgcaaagtgctttatgtaggaaaagagaatagggttgttctcggttacttcaaagggcaaaatcaagagctgtggcattgtgtggatggcagcttgtgaggggcagaacaccagggtggcagcattctcagccacctggcagtgaggccagggcactcagccacagctgatgtgcatatgatgcattagtagtgtgcatgtgtgtgtgtgtgcctgtgcacgctcttgtgtaaggagctgcatcactggtgtggccag

SEQ ID NO: 408112 - DNA, 634 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagggtcttgctctgtcacccaggctggagtgtgcactt

SEQ ID NO: 408113 - DNA, 233 bp, Homo sapiens
  misc_feature (1)..(1): n is a, c, g, or t
ngcacgaggtgaggttttctaccctcacagcaaagggatccttaactataaattcacggtatgcagagaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408114 - DNA, 3628 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408115 - DNA, 3521 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacgaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408116 - DNA, 3736 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaagacagggtcttgctccgtcacccaggctggagtgcagtggcgtgatcatggctcacttcagtgtccaactcctgggctcaagcaatcctcctgccttagccttccaaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408117 - DNA, 4005 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttcaaaaaaaaaaaaaaaaaaaaaaaaaaacaaaaaaacaagatgtgtgtgggggcgcacgacgggcgcccacgagaaaaagttttttcaaacaccatgcgggggggcggacgggggcacccaggaggaggagagacgaaacaggggggacaaaagggtgctcccagggaggaggacaccgggcgaaaaaaagaaaaaagcaggggcgagaggaatctctctccacaagataaaacaaaaacgagcgcgggggggaacacaacgaaggctgggtgaaaaagaaaacacaccgaaggagggggataggagaggggacaaaaaaggggggactaaacaaaaggagggataccaagagacacgcgaaacacaaattacccccc

SEQ ID NO: 408118 - DNA, 2991 bp, Homo sapiens
tgctagaactttgcttgtacttgccacatgagttggaagtgtactggtagggagctttagtttgcattttaaatgcgtgatagtgatttgttttgcttccttgctgatcagacaatgatgatcttcccttttcacagaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408119 - DNA, 2659 bp, Homo sapiens
tctgacggcaatgtgtctcctggagtgggcgcatatcagaaaactcagcccagctaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408120 - DNA, 3574 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaatttttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408121 - DNA, 1719 bp, Homo sapiens
gcactttgcgaggccaaggcaggaagattgcctgagcccaggagtttgagaccagctgggcaacatagtgagaccctgtctctacccaaaggggaaaaaaggatttaatcttctcatacagcttagtggagatcattttgtgatatctaattgagttgcttactcctttcagggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408122 - DNA, 2433 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaaccttcttctctggcaggttaatggtcgacgcg

SEQ ID NO: 408123 - DNA, 1106 bp, Homo sapiens
gtgcatgtctgtgccacttgctcattccagggggcgtaggtttatgcaagtcctgcttgtgcaccaatattttttctgtttctgtacttagagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408124 - DNA, 1918 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacttaaacttgatgcccagccaagcttgggtactcactc

SEQ ID NO: 408125 - DNA, 475 bp, Homo sapiens
tatatagttttgtgcaagctactttatgtctttgcctttttcccaattacaccagacgatttccaggggccctttgaactcttaaaattctaaaactttttgtatttagttggctctacctttctcccaatggggcttgtttagagcacagtcttcctgttagtgtgcatgtctgtgccacttgctcattccagggggcgtaggtttatgcaagtcctgcttgtgcaccaatattttttctgtttctgtacttagagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtaactgggagcatgagcactgacgaacacaa

SEQ ID NO: 408126 - DNA, 3324 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcct

SEQ ID NO: 408127 - DNA, 3354 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408128 - DNA, 3247 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408129 - DNA, 3758 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttcaaaaaaaaaaaaaaagggggggggatttaaaattccctgggggggccaagttaagcgttccaggttcttgacaaaggggccctaaggagtgataaaaggaggaagggcggcgttaaagtggatggaaagc

SEQ ID NO: 408130 - DNA, 3653 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggctgggctggagtttttctgatatggctgcctcaacttccagggaagaactccagcccagcctaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408131 - DNA, 3875 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactggaggtgacagttgtcaagtatgctttctcaggcacgggtaggtaaaagtctggagaaatgggttctctccatgcccaatgacaaagcaagacggtcctaggtttgaggttaagagcaggtcccattgccgggcggtatccgagctcacagctgaagttacagtggaatcgagtggagaattgggagatacaggcacagtcagaggctggtcacttgactttatctccagaccctggtacttgcgtattggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttc

SEQ ID NO: 408132 - DNA, 3109 bp, Homo sapiens
  misc_feature (3050)..(3050): n is a, c, g, or t
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggacgcgccatcgtgcgttcaagcgcacgatggcgcgttcctccggggccccgccttcttttctgggccgccttccgnaacctcctgggggagcccctctgtttctttctcccaggaacgggtccttctcggggggc

SEQ ID NO: 408133 - DNA, 3983 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgccgggcggtatccgagctcacagctgagaattatagcagtgggacctagcggataccgcccggcaatgggacctgcatcttaacctcaaaacaatgacaaagcaagacggaccatagagaaacgccgaggaacccaggcatgaggcaggcagagcatcactggcaagaacaaagccaacggagccaagaccgagagggacacaacggacaacacaacagacagaagacgatactgggacagatgagacatcccgatgaacaccacaacaatacatacaacgaaacaatcatgaacgacacgaaaggactgagcccaaagcatatcagggacccaatgagaatgcatggaagaacacacaagaaaccaaaaaaggccgtaacagttacattggagagacaccaacagaaacaacaccagagaaacaaagagagaacaacgatcaaatgacagatgcacacacagaagtatcaaaatagaaagaacaaaaacaacaatgatagcaaaaggcaccacatgaggatagaccaaagagggaacaaaaaatacaagatatcatacccagaaatcacaccaccagtccacctgaatgaaagaaatcggcagcaaagaaatatcgaagatcacgcacacaaagtaacagcacaaaaacggaaacagatgacgagcaagaaaaagagacacacccagtatgaaaaaaagacaagagaaacaaaatcacactaggagcaacacagaaaataagaaagcacacacatgaggatacaagaaaggcacacccgacaaggaagagacacaacaagaagagagaaagaagaagacagagaccaaatgaagagataacgacacagaacaaacgaacagagagtacaccagacatggcagagcaacagaaaaaggctagaagaggggccagacaagtcaagaaacaaaagggtcagcaaagacaatcaagacaatagaaggaaaaacgaaacaaatacaacacaaagaactaagcaaaagagagacaagaaacatcggacagaaaggacacatagacagatagaaaagagatagaggaagacaagaaagacg

SEQ ID NO: 408134 - DNA, 2395 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtggtaaggttgaggctatgtgtgctggcagaagtgtactgctcatgaccagatatccacccattcacacaaaagtttgggtagatattatgagcagggcatcatattaggaactgcaggtgataaagagacttatcggaagtggattttgcttttagttaactcaaagtctggtatgggagacaatatatgtgtgaataatagaaaatggacagaagtgttctgagagagatgacagttaaaataggaattcagaggagaaaatggtttcttccagatagaaagttcagggtgtgctttgtagagaggcacatttg

SEQ ID NO: 408135 - DNA, 1115 bp, Homo sapiens
cttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagctcaaggggtaccttggtggatatttcagtacttaaaaccagactgtaatcataacctccctctgtgtggcatcaataaatagccaaactc

SEQ ID NO: 408136 - DNA, 845 bp, Homo sapiens
  misc_feature (29)..(29): n is a, c, g, or t
gtattaaaagcgagagcaattcaaccccntcatcctttcatctcaaatataagcataacccctctatcaaattctcaatactgaaaaatgaagcctaaaatgaagtattcaaccaacaaaatttccacagcaaagtggaagaacacagcaagcaaagccttgtgtttcaagctgggaagtaaggacttaagttatctctgaatgttttacgcactatttttatctgttatcaaatatttatactccaatgtttatacatgctatcttatcaaaatctactaagaatacaagaactaaaataaaaagagatggcacataagggtataatacagcagactggttttgaaccaaccatatatagccaactttggcatatttgatacatcaccaggcaggaatagctgagataatctgaacctgtgaatagtgataaacttaattatagccttttatatcaaccactttttgctccacacacctcctgctgccaaacccccaaaaccttttccctgataaactagcaaacttttaagcaggtccacttttattcaacaaatattcattaagacctttggtggtatcaggcatgtggtcttaacttgcgactactgatgaagaagagaataacagatgaagatatttgaataatcatcttagtcaatttgtgttaccatagaaatatacctgaagctgggtaatttaaccctttgtccatttagaaaaaaaaagcgttagattgcttccccagctcatttaattccacctagccatcctcctagaagcttaagcgaatatgaactgcatatgcaaactaaaactataggaggtgtatgtgtaggtgccag

SEQ ID NO: 408137 - DNA, 3253 bp, Homo sapiens
aacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaaggtagattattttctttttctataataatgtaataatgactaataaaagtaaaacattttaataaatctaccaaactttaaacaatggattaacttagacatggcaaacaggtcatgctgtgtgctaactctaatgcattggcagtgggtgcctgaatccacttctatgtcaagatggattcagaagctttgtcaggttcatcagagaagaatgctgacattgaaatgcagtatctgttgtgaaagatggaaagaggggccacatgtatttgctatctctaaattatccaccagatctttctagccctattagtatcaccaaagtacaacctttatgccactgctatgaaaaatattttaaatattttaataacaactatattggagaattcatcagagcatattcgtgcatttttgagacctttctcaaaaccacaaaagatttgtttttattgatatataataaaaggggaggatattttctgatgttatgtgtgtgttggaactgaaaacttaacaaaattgtgtctcaccagagggattttatgcattctctttcagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctctgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtgcaataaacttaaaatgattattaaataatcaaatatatctacattgtttatattattgaataaagtatattttccaaatgtaaaaaaaac

SEQ ID NO: 408138 - DNA, 3161 bp, Homo sapiens
aagaaatcataatcacgatcacagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacagctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaaggtagattattttctttttctataataatgtaataatgactaataaaagtaaaacattttaataaatctaccaaactttaaacaatggattaacttagacatggcaaacaggtcatgctgtgtgctaactctaatgcattggcagtgggtgcctgaatccacttctatgtcaagatggattcagaagctttgtcaggttcatcagagaagaatgctgacattgaaatgcagtatctgttgtgaaagatggaaagaggggccacatgtatttgctatctctaaattatccaccagatctttctagccctattagtatcaccaaagtacaacctttatgccactgctatgaaaaatattttaaatattttaataacaactatattggagaattcatcagagcatattcgtgcatttttgagacctttctcaaaaccacaaaagatttgtttttattgatatataataaaaggggaggatattttctgatgttatgtgtgtgttggaactgaaaacttaacaaaattgtgtctcaccagagggattttatgcattctctttcagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctctgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtgcaataaacttaaaatgattattaaataatcaaatatatctacattgtttatattattgaataaagtatattttccaaatgtaaaaaaaac

SEQ ID NO: 408139 - DNA, 1944 bp, Homo sapiens
aacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctctgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtgcaataaacttaaaatgattattaaataatcaaatatatctacattgtttatattattgaataaagtatattttccaaatgtaaaaaaaac

SEQ ID NO: 408140 - DNA, 1651 bp, Homo sapiens
aacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctctgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaacgtcagcatccaaccttcgaaactatccgcctggaaaggaaacacaaccacggtaactccaaacggtcgcaatcggaccccggcctccccgaagaaatcaccacaacaccacccgcgcaaacaccgaccgcccagccaccgcgccaccccgcggccaccc

SEQ ID NO: 408141 - DNA, 718 bp, Homo sapiens
  misc_feature (29)..(29): n is a, c, g, or t
gtattaaaagcgagagcaattcaaccccntcatcctttcatctcaaatataagcataacccctctatcaaattctcaatactgaaaaatgaagcctaaaatgaagtattcaaccaacaaaatttccacagcaaagtggaagaacacagcaagcaaagccttgtgtttcaagctgggaagcatgtggtcttaacttgcgactactgatgaagaagagaataacagatgaagatatttgaataatcatcttagtcaatttgtgttaccatagaaatatacctgaagctgggtaatttaaccctttgtccatttagaaaaaaaagtgcagcttgctgccagcgcttatttaattttacataaacatctctttgaggctgaagcaaatctgattttcaatgcaaaaatagaatacaaaaactgttcttggagttatttctaaacagaactaccatcagcattgtctatttcagaaaaaatgagattcaccaaatgaaacttcagcaagcaactaactgttcaagaagtgttcaagaatgttaacatcacatgtaggaatgctacattttccaggatttgacattttcagcgatcaagaattactatattttatcaatgaaaataccactactaaaaacataaatagaatgatgtcttttgtttccaaagttgatatactagagagatgtaaaaataataataaaagcaagatctttcgtggc

SEQ ID NO: 408142 - DNA, 2693 bp, Homo sapiens
aacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctctgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtgcaataaacttaaaatgattattaaataatcaaatatatctacattgtttatattattgaataaagtatattttccaaatgtaaaaaaaac

SEQ ID NO: 408143 - DNA, 2639 bp, Homo sapiens
aacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctctgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattcctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtgcaataaacttaaaatgattattaaataatcaaatatatctacattgtttatattattgaataaagtatattttccaaatgtaaaaaaaac

SEQ ID NO: 408144 - DNA, 1730 bp, Homo sapiens
aacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaaggtagattattttctttttctataataatgtaataatgactaataaaagtaaaacattttaataaatctaccaaactttaaacaatggattaacttagacatggcaaacaggtcatgctgtgtgctaactctaatgcattggcagtgggtgcctgaatccacttctatgtcaagatggattcagaagctttgtcaggttcatcagagaagaatgctgacattgaaatgcagtatctgttgtgaaagatggaaagaggggccacatgtatttgctatctctaaattatccaccagatctttctagccctattagtatcaccaaagtacaacctttatgccactgctatgaaaaatattttaaatattttaataacaactatattggagaattcatcagagcatattcgtgcatttttgagacctttctcaaaaccacaaaagatttgtttttattgatatataataaaaggggaggatattttctgatgttatgtgtgtgttggaactgaaaacttaacaaaattgtgtctcaccagagggattttatgcattctctttcagataaggtgttactgagttactatgagtctcaacacccctcaaatgaatcaggtaatttggagggctgggtagctgtagtgcttgaattcttaagtatggggtaaagataaatccaaaaaaatcctttttgccccataggaaaaaagatagtctcagaaggttatctccaacccaagctcatggtaaaaccttagattctcagaggatgcattctcatccattttacagcttaatcgttaggataaagttttggctacacttaatacagatccaaaacaagagtggtttatgctagataaaactttctgtcttagccagggctgcaatggctcaacaagttgtccagggaacccatctccttctatcttgtggttctgccaacatctacatggttcaagagtacttgggagcatgacaatgcctggtcagcaggacacagaaaaacagatgtatgcattctatttccctttaagggtacaacctagaagttgcacctaacacttcctcttatctcacattggtcagaactcagttgtattactacacttagccataagaaggcaagctggggaatgttctattactatcccaaaagaggaatgaatattgggtgacactatgagtggctttacatgcagaca

SEQ ID NO: 408145 - DNA, 343 bp, Homo sapiens
caccaagatgcatgacagtgtcttcaagtagggaagatggcccaaaagatgattccagaacaatgtggacgtatagcgacagagatatacacatgttattgtggaagctgctgggattgactgctttgtgagctctggatggccagtccttgctatgggggctgggatggctgctgacaatggtgaccttccacaggcaacccagccagaagtgctgagcccctcccaggaaaggcaccagcgggcctgacagttaattatagagcccccttttttttttaaaggaagtaactcaatccactttaatatttagctagcatttatgttacaggtctatgaggga

SEQ ID NO: 408146 - DNA, 2298 bp, Homo sapiens
agcggcgcggctgctaggaggcaccgaggcagcggcggggctctgggcgcgcggctggatgcccccggcctgcggctccctgcgcttcccgccgtccaggggcaccagtcatgggcgccgcagccgctcaggcgcctctcgggctgcctgccgcgcctccgctcgccttctgctgctagcgacgtcggtgcttctgctcttcgccttctctctgcccgggagccgcgcgtccaaccagcccccgggtggtggcggcggcacggcggggactgtcccggcggcaaaggcaagagcatcaactgctcagaattaaatgtgagggagtctgacgtaagagtttgtgatgagtcatcatgtaaatatggaggagtctgtaaagaagatggagatggtttgaaatgtgcatgccaatttcagtgccatacaaattatattcctgtctgtggatcaaatggggacacttatcaaaatgaatgctttctcagaagggctgcttgtaagcaccagaaagagataacagtaatagcaagaggaccatgctactctgataatggatctggatctggagaaggagaagaggaagggtcaggggcagaagttcacagaaaacactccaagtgtggaccctgcaaatataaagctgagtgtgatgaagatgcagaaaatgttgggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacagatacagatgacactagtttgttgggaaagaaagatgatggactacaatatcgaccagatgtgaaagatgctagtgatcaaagagaagatgtttatattggaaaccacatgccttgccctgaaaacctcaatggttactgcatccatggaaaatgtgaattcatctattctactcagaaggcttcttgtagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactataaagcctct

SEQ ID NO: 408147 - DNA, 2354 bp, Homo sapiens
aaaaaaattaaaaaaaaaaaaaaaaacagaaaaaaaaacatagtacatgccaagatattattatgacaattacaaatacaaataaattatgatctttgacctcagcatatttattaactaaaagggaagataaaacaggcacataactataacaggggcaccagtcatgggcgccgcagccgctcaggcgcctctcgggctgcctgccgcgcctccgctcgccttctgctgctagcgacgtcggtgcttctgctcttcgccttctctctgcccgggagccgcgcgtccaaccagcccccgggtggtggcggcggcacggcggggactgtcccggcggcaaaggcaagagcatcaactgctcagaattaaatgtgagggagtctgacgtaagagtttgtgatgagtcatcatgtaaatatggaggagtctgtaaagaagatggagatggtttgaaatgtgcatgccaatttcagtgccatacaaattatattcctgtctgtggatcaaatggggacacttatcaaaatgaatgctttctcagaagggctgcttgtaagcaccagaaagagataacagtaatagcaagaggaccatgctactctgataatggatctggatctggagaaggagaagaggaagggtcaggggcagaagttcacagaaaacactccaagtgtggaccctgcaaatataaagctgagtgtgatgaagatgcagaaaatgttgggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacagatacagatgacactagtttgttgggaaagaaagatgatggactacaatatcgaccagatgtgaaagatgctagtgatcaaagagaagatgtttatattggaaaccacatgccttgccctgaaaacctcaatggttactgcatccatggaaaatgtgaattcatctattctactcagaaggcttcttgtagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactataaagcctct

SEQ ID NO: 408148 - DNA, 2199 bp, Homo sapiens
aagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaattaaatgtgagggagtctgacgtaagagtttgtgatgagtcatcatgtaaatatggaggagtctgtaaagaagatggagatggtttgaaatgtgcatgccaatttcagtgccatacaaattatattcctgtctgtggatcaaatggggacacttatcaaaatgaatgctttctcagaagggctgcttgtaagcaccagaaagagataacagtaatagcaagaggaccatgctactctgataatggatctggatctggagaaggagaagaggaagggtcaggggcagaagttcacagaaaacactccaagtgtggaccctgcaaatataaagctgagtgtgatgaagatgcagaaaatgttgggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacagatacagatgacactagtttgttgggaaagaaagatgatggactacaatatcgaccagatgtgaaagatgctagtgatcaaagagaagatgtttatattggaaaccacatgccttgccctgaaaacctcaatggttactgcatccatggaaaatgtgaattcatctattctactcagaaggcttcttgtagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactataaagcctct

SEQ ID NO: 408149 - DNA, 526 bp, Homo sapiens
  misc_feature (20)..(20): n is a, c, g, or t
gggaaagcgggtttccagtnaggagttaaaagacggcgggatgtaaaagaatcatataggggatgggccggaattgatgttccggccgcatggcggccggggattggatgacggatcagaaagtagagaaagaaggtaactttgctgaaagctagtctggggagttagtagctgatacagatcagcatttcctaactatgagatttcataatattctctcttgtctcgattctgagtcactggtgcctgctgtggtggcattgttcatgaacatgtacagttattgggaagtgatcttgtctttcctcctgccttcaggcactgctacctaaattacaccccgacagatgtattcccattcttctttaaaagactatgtcatgagctgaactattaagttttaaagttgataagcatcaggctaagcatatttttcctgccatctcccacggaggtataacattgttttctatacttagggaatttaccaaaaaaaaaagtcgacgcggccgcgaatttagtagta

SEQ ID NO: 408150 - DNA, 406 bp, Homo sapiens
gactgaagcacaagaactgcttgaacccgggaggcggaggttgcagtgagctaagatcacgtcactgcactccagcctgggcaacagagcaagactgtctcaaacaaaacaaaagaacaaaactctctgggcttgatttcttaatctgtaaaacagaaataattcttaacacatttggttactctgaggataaaagtggaggaaaaaacatgcagaggatagtccggaactccccatgtagatcccattattaggtaactgaggtacaagtatcttaggctactggtccgggcaggctttgctgaggggctccgtgcagcttgctggtgcagccgagcaagtgggcctgtagccgactcttaatccaggttggtgctattcaaagagatcatctttcacccgaggg

SEQ ID NO: 408151 - DNA, 2015 bp, Homo sapiens
  misc_feature (1412)..(1412): n is a, c, g, or t
atagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttggttatttataatcatcagacatctcgaaagattcctgtccttggaaaacatactaagagaatcacttgtggatgttggaatgcagaaaatctgcctgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcangaagaacgtgagactcggcttttcccagcagtggatgataagtgccgtatcttatgccatgccttaactagtgatttcctcatctatggtacagatactggtgtcgttcagtatttctacatctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacatactctatcctctgcactgttaatagtaacctatgacataattgtaaatattcagctttttgctaacttttgtattttgaaaaactttaaaataaaattgttgactagaaaaaaaaaac

SEQ ID NO: 408152 - DNA, 727 bp, Homo sapiens
tcttttcttccgaagcattcttctatttgtgttcctaaggatctctaaagactcaaattgtcttctgggaagaacctcctgtgacctttgagaatattatctttaaagaggatcttgcatgagactgaatagttctgattctcaaattgcatggtggacatgtgttaagaggtgtagacagaaagttgttgtctttctcattagagtaacccaaagctaaaggaatgttatatatttaatttactctgcctttccctcccctaaacagcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacatactctatcctctgcactgttaatagtaacctatgacataattgtaaatattcagctttttgctaacttttgtattttgaaaaactttaaaataaaattgttgactagaaaaaaaaaac

SEQ ID NO: 408153 - DNA, 3429 bp, Homo sapiens
  misc_feature (710)..(710): n is a, c, g, or t
caggctcttgacagacaagtggaagggctgtaccaggataaaggaaagaagtgcctgtccagcagggagcttgaatttaagttccatgtatgaagccacgtcgtcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcangaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggtaggcagagatggctatttctgctatctaatcgtatttctcaaagtatttccaaaaatgtagctgccagtgtgcaagctcaataagaaaacggtggggggccaggtgcagtggctcacacctataatcccaacactttggaaggctgaggtggacaaatcacttgaggtcagtagttcaagaccagcctggccaatatgatgaaaccctatctctactaaaaatacaaaaattggctgggcgtggtggtgcacacctgtagtcccagctactcaggaggctggggcaggagaattgcttgaacccgggaggcagaggttgcagtgagccgagatcgtgccattgcactccagcctgggcaacagagtgagaccccatctcaaaaa

SEQ ID NO: 408154 - DNA, 4405 bp, Homo sapiens
  misc_feature (1412)..(1412): n is a, c, g, or t
atagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttggttatttataatcatcagacatctcgaaagattcctgtccttggaaaacatactaagagaatcacttgtggatgttggaatgcagaaaatctgcctgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcangaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacatactctatcctctgcactgttaatagtaacctatgacataattgtaaatattcagctttttgctaacttttgtattttgaaaaactttaaaataaaattgttgactagaaaaaaaaaac

SEQ ID NO: 408155 - DNA, 1056 bp, Homo sapiens
gacagttctattggacggtgctggtataacttgtaccacttctgttacacaaaagggagagacagagggaaaataccaagctcaccactccagtagcacaggaagagagaagaccgcaagacctacccatgctttctgccgttgaatgtgctatgaactccagttcccaaaggtggcccatgtaacaccctagaacctaaccaatcctaggtactcttcctcctccctggagtggatcaagggctggtgtgagcttgtaagtatctctctaagcccagagtctgactatgaagtaggtgtgtcatatgtccctggttttccaaatatgctttctctttgccatccccggtacatgaataaaacggcatttttaaatgacatgattcttcctcacaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacatactctatcctctgcactgttaatagtaacctatgacataattgtaaatattcagctttttgctaacttttgtattttgaaaaactttaaaataaaattgttgactagaaaaaaaaaac

SEQ ID NO: 408156 - DNA, 1328 bp, Homo sapiens
tatttttgttgttgttacatcaaagtctaccatgcgggcaaggtatgggataggacaggcactctcatgactgctggtggggatggaaattggtatggcctttgcagaaagcagtttggcaatttgtggtaagagtattttttaaaaggtcctgtttttgagccagtaattctgggtgtctgtcctgaagaaagaatttgatgcctgcagagagattagtgtataaagtcattaatccccctaatgcttttatcagcagtcctgtcagatgcaaaaaatatctaagaggcatgaaaggaaactcatggaagtgttgcctcaaggggtgcaggtcctagtgttacaaggcagaacatggtgtcatcaaaggaaaagcacttgatgggcagttagcctgaccccacagctacgtactttcctcattaaacagatcatatctggttctttgcagaaaaagcaaagttcagagaccatgaccctgttttcctacagaaccagggtggaatcccgcctgtatcactgaggacagcagacactgtgctgttgctgctctccccttttctcttgcagacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtatggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacatactctatcctctgcactgttaatagtaacctatgacataattgtaaatattcagctttttgctaacttttgtattttgaaaaactttaaaataaaattgttgactagaaaaaaaaaac

SEQ ID NO: 408157 - DNA, 2705 bp, Homo sapiens
  misc_feature (1412)..(1412): n is a, c, g, or t
atagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttggttatttataatcatcagacatctcgaaagattcctgtccttggaaaacatactaagagaatcacttgtggatgttggaatgcagaaaatctgcctgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcangaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgctttgccacatttctgttccttataaatgcctataccaaaaagtgacgttggaatcttagtacataacacaagagacagagccccattgccctggccctccacctgcatcctgaggatgactgagtcttagaatataaaacttctgtgctaagaaggaaagatgatccaccaagtcctgtcagagtacagacaccccagtaagccctcggaccatccagaactcttcgattttcacttccttcaggaaaattgaagttttgtaacaaattctcaaacttgtctcattatggtcagatgaattgagttcaattga

SEQ ID NO: 408158 - DNA, 505 bp, Homo sapiens
gcaaggctaatactgaaacttgatgcggattacagtctagagatttctaacttgaatgtttcctgttccacattctagaaacaggcaaaaaaaaattctttttagtatgtttggctttattactaaatgccagccattacttgaaacccttctagaggcatgtgttctgtttgtcctttctagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacatactctatcctctgcactgttaatagtaacctatgacataattgtaaatattcagctttttgctaacttttgtattttgaaaaactttaaaataaaattgttgacta

SEQ ID NO: 408159 - DNA, 641 bp, Homo sapiens
tttagtagagacggggtttctccatgttggtcaagctggtcccgaactcctgacctcaggtgatccgcttgcctcggcctcccaaagtgctgggattacaggtgtaagccactgcgcccagccactttgtttcttatcaataccttcttgtcctctctgtcaatctaaaataatctttcaaaagttgatcatacaaattatgtctcgattccagatgtgattcatttgtaaaggtgcgtggcgagtttgttttatcaaaaggcagggttctttataggactgaagaaaatctgctaacttaagtatgattatatttaatgtagtatatgaaaatggtattaaaagtaaaattttaaattttaccgtcccctcaaccacagcaaaaaaattgaagttaacattacccatgcagtgaataatgagttgtatttctcactttagagagtttattatctgttcaaaatagattgaataatcttgttatagacaaaaatcacaaatagtaattttactttaaaaaactgtatagtggtattttgctctcttttttaaaagtaactgtgttgccatggattgggataaagatggagatgtcctagcagtgattgctgagaaatctagctgcatttatctttgggatg

SEQ ID NO: 408160 - DNA, 4131 bp, Homo sapiens
  misc_feature (1412)..(1412): n is a, c, g, or t
atagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttggttatttataatcatcagacatctcgaaagattcctgtccttggaaaacatactaagagaatcacttgtggatgttggaatgcagaaaatctgcctgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcangaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggtaggcagagatggctatttctgctatctaatcgtatttctcaaagtatttccaaaaatgtagctgccagtgtgcaagctcaataagaaaacggtggggggccaggtgcagtggctcacacctataatcccaacactttggaaggctgaggtggacaaatcacttgaggtcagtagttcaagaccagcctggccaatatgatgaaaccctatctctactaaaaatacaaaaattggctgggcgtggtggtgcacacctgtagtcccagctactcaggaggctggggcaggagaattgcttgaacccgggaggcagaggttgcagtgagccgagatcgtgccattgcactccagcctgggcaacagagtgagaccccatctcaaaaa

SEQ ID NO: 408161 - DNA, 1381 bp, Homo sapiens
tatttttgttgttgttacatcaaagtctaccatgcgggcaaggtatgggataggacaggcactctcatgactgctggtggggatggaaattggtatggcctttgcagaaagcagtttggcaatttgtggtaagagtattttttaaaaggtcctgtttttgagccagtaattctgggtgtctgtcctgaagaaagaatttgatgcctgcagagagattagtgtataaagtcattaatccccctaatgcttttatcagcagtcctgtcagatgcaaaaaatatctaagaggcatgaaaggaaactcatggaagtgttgcctcaaggggtgcaggtcctagtgttacaaggcagaacatggtgtcatcaaaggaaaagcacttgatgggcagttagcctgaccccacagctacgtactttcctcattaaacagatcatatctggttctttgcagaaaaagcaaagttcagagaccatgaccctgttttcctacagaaccagggtggaatcccgcctgtatcactgaggacagcagacactgtgctgttgctgctctccccttttctcttgcagacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacatactctatcctctgcactgttaatagtaacctatgacataattgtaaatattcagctttttgctaacttttgtattttgaaaaactttaaaataaaattgttgactagaaaaaaaaaac

SEQ ID NO: 408162 - DNA, 4351 bp, Homo sapiens
  misc_feature (1412)..(1412): n is a, c, g, or t
atagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttggttatttataatcatcagacatctcgaaagattcctgtccttggaaaacatactaagagaatcacttgtggatgttggaatgcagaaaatctgcctgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcangaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggagccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacatactctatcctctgcactgttaatagtaacctatgacataattgtaaatattcagctttttgctaacttttgtattttgaaaaactttaaaataaaattgttgactagaaaaaaaaaac

SEQ ID NO: 408163 - DNA, 546 bp, Homo sapiens
aatgaagtataaagcgttgagctcaaccctttatacttctcaacgctttatacttcctcaacgctttatacttctcaaacgctttatacttccaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcggaagagacctgga

SEQ ID NO: 408164 - DNA, 351 bp, Homo sapiens
  misc_feature (341)..(341): n is a, c, g, or t
aaatcagtcgtaccgtccacccgacggggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccgtcgggtggagcaccccgtcgggtggagcaccccgtcgggtggagcaccccgtcgggtggagcancccctcgggt

SEQ ID NO: 408165 - DNA, 404 bp, Homo sapiens
gccaaagaattcggcacgaggggtgacatgtgcctttaatcccaggtactaaggaagctgaggtaggaggatgacttgagcctaggagttcgaggctgcacaattattgtgccagacccctaggttaacagtgaggattcagtgggagaactaaacagataaacagatccagtccccgccctcagagagttacagtttaatgggaaaaagagacattcaccaaagaaggacacagcccactagtgagttacactcgagagggatcatttacagaacaaagcagattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408166 - DNA, 630 bp, Homo sapiens
tattaggactctggggcggcggtggcggacacttggggtctggacgcaacggcggcgggagcatgaacgcccctccagccttcgagtcgttcttgctcttcgagggcgagaagtaagtgacgccggctgcggagggccgaggatcaccattaacaaggacaccaaggtacccaatgcctgtttattcaccatcaacaaagaagaccacacactgggaaacatcattaaatcgtaagtttcccgtcacaggctctcaggggctatgtttaatgggcccctctgggcaaagcacaagttccaagtcttcctcagtctctctgagctacaggaagtccttctgggggcttgctctgggcattttataatcttggtacctttttatcaaaatgacaccgacctccatgtcttcacataagccacacttctgtagtggcttattctgtagatgaacacgtgcatttacattcactgtttggttgtctgttagtttttgagatggaattttctctctttgttgcccaggctggagtgcaatggcacgatcttgctcactgcaacctccgcctcccgggttcaagtgattctcctgcttcagccttcctagtagctgggactacaggcccacgccac

SEQ ID NO: 408167 - DNA, 431 bp, Homo sapiens
tattaggactctggggcggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagcgagctgtccctgctggaggagcgcttccggacgtgcctgcttccccttcgccttcccaaagcacagcgccgtcccaaagcacag

SEQ ID NO: 408168 - DNA, 395 bp, Homo sapiens
gagttttttaccagggtccccccaaaaaaaaaaaaaaaaaaaaaaaaaaagagaaagaaagtatcatgcttttctgcattctgtgaattgttttagtgagttatcgaacttgagggcatggtgggaacctccaaatttgcagccagttggtgagaagtacatgtggtctgaggacacccaagcctgcaggtgtgtctaaagcgagggcagcctagtggggactggtggccttaacctgtgtgagcactgcacccagccttatgtttttttctacataaaaaacagcacaggattatcttccagagctaataaatatgttcaaataaccacaaccccattaaggaaaaatatcactgggcagcaaataatcaatccagaccaagggatcatcacaa

SEQ ID NO: 408169 - DNA, 522 bp, Homo sapiens
gtgatgatcccatcaggcagggagaccccacaaggctcagagagggccaaagcgtgcacaggacaccgagtgagctctatctcgctcatagggattctgattccaaatacggggctccttctgctaagacacactcaaatcaacaccctgaagacacaacagaaagaacaatgaaaattgtccatttgtagaattttcttccccaagctatcaaggtagctaaatgtttagctttgttataaaaaataaagataaaaaataaaaattaaaaatggatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaagggatcatcacaa

SEQ ID NO: 408170 - DNA, 425 bp, Homo sapiens
acactgaccagaacttaagatggttatatacaatttacaaatctcaaagaaagtactacttaaaaaaaaaaaaaagagaaagaaagtatcatgcttttctgcattctgtgaattgttttagtgagttatcgaacttgagggcatggtgggaacctccaaatttgcagccagttggtgagaagtacatgtggtctgaggacacccaagcctgcaggtgtgtctaaagcgagggcagcctagtggggactggtggccttaacctgtggcatttgaggtaacatcagggagttgacatcagaattgcatcacataggctgggcgcggtggctcacgcctgtaatcctagcactttgggaggccaaggcgggcagatcacgaggtcaggagatcgagaccatcctggctaagacagtgaaatcccgtct

SEQ ID NO: 408171 - DNA, 246 bp, Homo sapiens
gcggccgcctactactactactgctcgaattcaagcttctaacgatgtacggggacatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408172 - DNA, 930 bp, Homo sapiens
cttgggggatttcaacgtctgagtcgtctgctcaccaggaagcctctggggcctctgactcctgccggggctgccatagagaatggctggattgggccagctgggagggccctttggctgctccactgtcctggggagtgtggcccatggctgccctccaggaagggcctggcgggggggatgctgggcatgtgtttccagcgtccttgccccagctgttccagctcagtctccaccaccttcttctctcccaggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcggaagagacctggatgtggacttgagcagcggtgacttcgcaagcaaatggattgtcaggcttgatgcaggcagatgacctgtttcaggggcgtccggctggcagggatgaattcattctggaccaaagatccggggtccaggggctgctgcgggggctgtgctgagccggagagaagtgtgcaaacccatgagctcccaagagtctctgctctagaagcctcaactcctgggcctgcctgtcagtcaaagcaggaacacttcttcctgcataactcgaaacacctttccacaggcttcttgtccacagtagagtttaataaaaatattcactgaaagaccccccccacccccatcggcccaaagctgaataagttagttagctgtgtccctggtcctttgcgatggtgtgaggctacatcctcccccagatggctacgatgttggagtccgtcag

SEQ ID NO: 408173 - DNA, 625 bp, Homo sapiens
gcggccgcctactactactactgctcgaattcaagcttctaacgatgtacggggacatggcccgccttgtggccacccctcaccatggcccgccttgtggccacccctcaccctgacaccgacgtgtcctgtacatagattaggttttatattcctaataaagtatagcggaagagacctggatgtggacttgagcagcggtgacttcgcaagcaaatggattgtcaggcttgatgcaggcagatgacctgtttcaggggcgtccggctggcagggatgaattcattctggaccaaagatccggggtccaggggctgctgcgggggctgtgctgagccggagagaagtgtgcaaacccatgagctcccaagagtctctgctctagaagcctcaactcctgggcctgcctgtcagtcaaagcaggaacacttcttcctgcataactcgaaacacctttccacaggcttcttgtccacagtagagtttaataaaaatattcactgaaagaccccccccacccccatcggcccaaagctgaataagttagttagctgtgtccctggtcctttgcgatggtgtgaggctacatcctcccccagatggctacgatgttggagtccgtcag

SEQ ID NO: 408174 - DNA, 156 bp, Homo sapiens
gcggccgcctactactactactgctcgaattcaagcttctaacgatgtacggggaccatggcccgccttgtggccacccctcaccctgacaccgacgtgtcctgtacatagattaggttttatattcctaataaagtatagcggaagagacctgga

SEQ ID NO: 408175 - DNA, 783 bp, Homo sapiens
tgattctcctgcctcagtctcccaggtagctggactacaggcatggatcaccacgctcagctaattttttttttctttgtatttttagtacaggcagggttttgccatgttgggcgggctggtcttgaacttctgacctcaggtcatccatccacctcagcctcccaaagtgttgggattacaggcacgagccaccacacctggccgggaggagacagggtttagactcagggtgggaggaggggagcccctgctcctcatctgtggcctctgtgtcttcctaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcggaagagacctgga

SEQ ID NO: 408176 - DNA, 625 bp, Homo sapiens
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcggaagagacctgga

SEQ ID NO: 408177 - DNA, 2811 bp, Homo sapiens
  misc_feature (503)..(503): n is a, c, g, or t
  misc_feature (801)..(801): n is a, c, g, or t
  misc_feature (830)..(830): n is a, c, g, or t
  misc_feature (1055)..(1055): n is a, c, g, or t
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactagacggggtttttccacgttggtcnggctggtctcaaacttctgacctcagatgatccgcccaccttggccacccaaagtgctgggattacaggtgtgaaccactgcgcccggccagaagtttttcttgtgagttgaggtgaacatctgaatcccctcggggaactgaggaggaggaactaccctgccctgacagaggctggggatgaaggaggaagagacagccggtcccctggataaagaggtgagggggtgtgaagtctgggagcccccctcccagggccaggctacagggggacagcagggctataccaggagtgccanagagcttgcatttgggtgtgatctaatcnccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttccccagggtggggnctgagaatctgagtgcagtggtgccatcttggctcactgcagcctcaacctcgctcgagtgatcctcccacctcaggtcctaaaggaagagtcgctacattggggactgtttggacaaggagatccacggggtagacttagcgggattgtccctggggcagcctggatcctgaggctgccccgcctccttcctcagcccctccctggtcaggcgctcctggtgggtggggggggtagtccaggcttgtcttgcaactgtatgttctcttcagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408178 - DNA, 1781 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctcccctgcctgtccgtgacatcatacacctgggtagtctttctgcaccactgcccctggctcctcctcctgaggaggtccccaagggcgtgtaggaccagggcaaggctcaggatcctagagaaattgtcacctggggcaggacaggcctctctgccagccttactgtccctatctgtaaaatgaggatggtaaccctgaacccacaaggccacagtaaggctaaaccaaggtgaacatgccttgggaactgtgaagactgtggaccccaagccggttgcggtggctcaggcc

SEQ ID NO: 408179 - DNA, 1656 bp, Homo sapiens
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408180 - DNA, 1631 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctctatggaagagcttcgctgagatcacataaatgcttgctgtctaaggctggggggggcccaccgtcctatttggcccttttgggagtcttgttacattaattgcccgtggtcacccaccgtccagactggtaaaaccctgtt

SEQ ID NO: 408181 - DNA, 1825 bp, Homo sapiens
  misc_feature (503)..(503): n is a, c, g, or t
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactagacggggtttttccacgttggtcnggctggtctcaaacttctgacctcagatgatccgcccaccttggccacccaaagtgctgggattacaggtgtgaaccactgcgcccggccagaagtttttcttgtgagttgaggtgaacatctgaatcccctcggggaactgagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408182 - DNA, 2980 bp, Homo sapiens
  misc_feature (782)..(782): n is a, c, g, or t
  misc_feature (944)..(944): n is a, c, g, or t
  misc_feature (973)..(973): n is a, c, g, or t
  misc_feature (1198)..(1198): n is a, c, g, or t
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatccgtaagtttcccgtcacaggctctcaggggctgtgtttaatgggcccccctgggcaaagcacaagttccaagtcttcctcagtctctctgagctacaggaagtccttctgggggcttgctctgggcattttataatcttggtacctttttatcaaaatgacaccgacctccatgtcttcacataagccacacttctgtagtggcttattctgtagatgaacatgtgcatttacattcactgtttgtttgtttgtttttgagatggaattttctctctttgttgcccaggctggagtgcaatggcaacgatcttggctcactgaaacctcggcctcccgggttcaagtaattctcctcttcagccttcctagtagctgggactacaggcccacgccacgatgcccggctaatttttgtgtttttagtagagatggggattcactgtgttggccaggctggtctcgaactcctgacctcaggtgatccacctgccggcttcccaaagtgctgggattacaggcgtgagccaccatgcctggacttccatctggtaattntctgtctcgaggaggaactaccctgccctgacagaggctggggatgaaggaggaagagacagccggtcccctggataaagaggtgagggggtgtgaagtctgggagcccccctcccagggccaggctacagggggacagcagggctataccaggagtgccanagagcttgcatttgggtgtgatctaatcnccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttccccagggtggggnctgagaatctgagaaccttgagcctgggaggtcaaggcctgcagtggtgccatcttggctcactgcagcctcaacctcgctcgagtgatcctcccacctcaggtcctaaaggaagagtcgctacattggggactgtttggacaaggagatccacggggtagacttagcgggattgtccctggggcagcctggatcctgaggctgccccgcctccttcctcagcccctccctggtcaggcgctcctggtgggtggggggggtagtccaggcttgtcttgcaactgtatgttctcttcagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408183 - DNA, 1914 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactatgatccgcccaccttggccacccaaagtgctgggattacaggtgtgaaccactgcgcccggccagaagtttttcttgtgagttgaggtgaacatctgaatcccctcggggaactgagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408184 - DNA, 1773 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaaaagtaagtgacgccggctgcggagggccgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgaggaggaactaccctgccctgacagaggctggggatgaaggaggaagagacagccggtcccctggataaagagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408185 - DNA, 1801 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgccggacatggtggctcacacctggaatcccagaacttcaggaggctgaggtgggaggatcacttgagcccaggaatttgagaccagcctgggcaagaggaggaactaccctgccctgacagaggctggggatgaaggaggaagagacagccggtcccctggataaagaggcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408186 - DNA, 1645 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408187 - DNA, 2373 bp, Homo sapiens
  misc_feature (503)..(503): n is a, c, g, or t
  misc_feature (801)..(801): n is a, c, g, or t
  misc_feature (830)..(830): n is a, c, g, or t
  misc_feature (1055)..(1055): n is a, c, g, or t
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactagacggggtttttccacgttggtcnggctggtctcaaacttctgacctcagatgatccgcccaccttggccacccaaagtgctgggattacaggtgtgaaccactgcgcccggccagaagtttttcttgtgagttgaggtgaacatctgaatcccctcggggaactgaggaggaggaactaccctgccctgacagaggctggggatgaaggaggaagagacagccggtcccctggataaagaggtgagggggtgtgaagtctgggagcccccctcccagggccaggctacagggggacagcagggctataccaggagtgccanagagcttgcatttgggtgtgatctaatcnccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttccccagggtggggnctgagaatctgagtgcagtggtgccatcttggctcactgcagcctcaacctcgctcgagtgatcctcccacctcaggtcctaaaggaagagtcgctacattggggactgtttggacaaggagatccacggggtagacttagcgggattgtccctggggcagcctggatcctgaggctgccccgcctccttcctcagcccctccctggtcaggcgctcctggtgggtggggggggtagtccaggcttgtcttgcaactgtatgttctcttcagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctggacctgcctcctcccaaagtcctctctgggggctctgggccatggcacagcaggacagccaccagaagccactgtcagagtctgatgggtgaggacggaaggtggctcaggagtccttccttagggcagggacaattttttccaggagaggtgtgaggcctccagctcc

SEQ ID NO: 408188 - DNA, 1097 bp, Homo sapiens
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgttggccacccctcaccctgacaccgacgtgtcctgtacatagattaggttttatattcctaataaagtatagcggaagagacctggatgtggacttgagcagcggtgacttcgcaagcaaatggattgtcaggcttgatgcaggcagatgacctgtttcaggggcgtccggctggcagggatgaattcattctggaccaaagatccggggtccaggggctgctgcgggggctgtgctgagccggagagaagtgtgcaaacccatgagctcccaagagtctctgctctagaagcctcaactcctgggcctgcctgtcagtcaaagcaggaacacttcttcctgcataactcgaaacacctttccacaggcttcttgtccacagtagagtttaataaaaatattcactgaaagaccccccccacccccatcggcccaaagctgaataagttagttagctgtgtccctggtcctttgcgatggtgtgaggctacatcctcccccagatggctacgatgttggagtccgtcag

SEQ ID NO: 408189 - DNA, 1098 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacacca

SEQ ID NO: 408190 - DNA, 2118 bp, Homo sapiens
  misc_feature (503)..(503): n is a, c, g, or t
  misc_feature (801)..(801): n is a, c, g, or t
  misc_feature (830)..(830): n is a, c, g, or t
  misc_feature (1055)..(1055): n is a, c, g, or t
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactagacggggtttttccacgttggtcnggctggtctcaaacttctgacctcagatgatccgcccaccttggccacccaaagtgctgggattacaggtgtgaaccactgcgcccggccagaagtttttcttgtgagttgaggtgaacatctgaatcccctcggggaactgaggaggaggaactaccctgccctgacagaggctggggatgaaggaggaagagacagccggtcccctggataaagaggtgagggggtgtgaagtctgggagcccccctcccagggccaggctacagggggacagcagggctataccaggagtgccanagagcttgcatttgggtgtgatctaatcnccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttccccagggtggggnctgagaatctgagtgcagtggtgccatcttggctcactgcagcctcaacctcgctcgagtgatcctcccacctcaggtcctaaaggaagagtcgctacattggggactgtttggacaaggagatccacggggtagacttagcgggattgtccctggggcagcctggatcctgaggctgccccgcctccttcctcagcccctccctggtcaggcgctcctggtgggtggggggggtagtccaggcttgtcttgcaactgtatgttctcttcagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgacatggactgcagggtatggccgcggcagcccagctcttaaggggacagcctgggaaaacagacttagggacaatgatcttgagccatgaaatgatgtccaatgcccc

SEQ ID NO: 408191 - DNA, 729 bp, Homo sapiens
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgcggcttttcatcttactctccttatgcacggccatcctctgggccagaatgccaatcctacgggaaaacccttaagtgacaaatggccacaaaagacaaggagacacccaccaagaagtgacagtcgcagtaaaagctaagcaccttcgggagttcccgggtagtctagggggttgggagttccctggtggtctagtggttaggattcggtgctttcaccactgccggaagaagaaaatgat

SEQ ID NO: 408192 - DNA, 2991 bp, Homo sapiens
  misc_feature (158)..(158): n is a, c, g, or t
gcaagactccgtctcaaaaaaaaaaaaaagagagagaaagtatcatgcttttctgcattctgtgaattgttttagtgagttatcgaacttgagggcatggtgggaactccaaatttgcagccagttggtgagaagtacatgtggtctgaggacacccnagcctgcaggtgtgtctaaagcgagggcagcctagtggggactggtggccttaacctgtggcatttgaggtaacatcagggagttgacatcagaattgcatcacataggctgggcacggtggctcatgcctgtaatcccagcactttgggaggccaaggtgggtggatcacctgaggtcaggagttcgagaccagcctggccaacatggtgaaaccccgtctctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacgtccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaaaaaaagtccgggcttgatggctcacacctgtaatcccagcactttgggaggccaagacgggtggatcacgaggtcaggagttcaagaccagcctggcctagatggtgaaaccctgtctctactaaaactacaaatattagctgggcatggtggcatgcacctgtaatctcagctactcagaagtctgatgcaggagaattgctaaaaccgaggagggagaggttgcagtgagccgagattgcaccactgcactctagcctgggcgacagagcaagactccgtctcgaaagaaagaaagaaagaaaggaaattccccagggaagtacctcggctgatttcataaacaggtaccgaaggaagcagaggcatgtggaggacttccccacctcatgcagctatttgggccgtggcgtctgaaatttattatttcagagtcacccctttgatgaccttggcagtgaactgcagtcatctgtttaggcctttccatggcccacgtcaatgccgttatttctgtttgttgcacatttgatttccttgttgttggcatttagaaggccccctgcttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcacttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggtcactgtactccagcctgggtgacagagcaagactccgtctcaaaaaaaaaaaaaagagaaagaaagtatcatgcttttctgcattctgtgaattgttttagtgagttatcgaacttgagggcatggtgggaacctccaaatttgcagccagttggtgagaagtacatgtggtctgaggacacccaagcctgcaggtgtgtgtgtgtggcggggatagggtgtccccacatgaggtatcttcctgaaagtgttactttccttgaagactttttgggaaaaaagttgggggggatttttggctagaaagtctgttcttctgctctgagctggctgctacccagcttgggcatgaggctagaccctcacactgccttcacaatg

SEQ ID NO: 408193 - DNA, 3507 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagcgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaagaaaagccgagcaggtgatcacgaggtcaggagttcaagaccagcctggcaaacatggtgaagccctgtttctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacgtccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaaaaaaagtccgggcttgatggctcacacctgtaatcccagcactttgggaggccaagacgggtggatcacgaggtcaggagttcaagaccagcctggcctagatggtgaaaccctgtctctactaaaactacaaatattagctgggcatggtggcatgcacctgtaatctcagctactcagaagtctgatgcaggagaattgctaaaaccgaggagggagaggttgcagtgagccgagattgcaccactgcactctagcctgggcgacagagcaagactccgtctcgaaagaaagaaagaaagaaaggaaattccccagggaagtacctcggctgatttcataaacaggtaccgaaggaagcagaggcatgtggaggacttccccacctcatgcagctatttgggccgtggcgtctgaaatttattatttcagagtcacccctttgatgaccttggcagtgaactgcagtcatctgtttaggcctttccatggcccacgtcaatgccgttatttctgtttgttgcacatttgatttccttgttgttggcatttagaaggccccctgcttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcacttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggtcactgtactccagcctgggtgacagagcaagactccgtctcaaaaaaaaaaaaaagagaaagaaagtatcatgcttttctgcattctgtgaattgttttagtgagttatcgaacttgagggcatggtgggaacctccaaatttgcagccagttggtgagaagtacatgtggtctgaggacacccaagcctgcaggtgtgtgtgtgtggcggggatagggtgtccccacatgaggtatcttcctgaaagtgttactttccttgaagactttttgggaaaaaagttgggggggatttttggctagaaagtctgttcttctgctctgagctggctgctacccagcttgggcatgaggctagaccctcacactgccttcacaatg

SEQ ID NO: 408194 - DNA, 2409 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgtgagtcaattaaacctcttttcttcataaattacccagtttctcatagttctttatagcagtgtgaaaacagactaatggacccttctggttgaaggaatgcagccattctgcttgtttgactatgtcctttctattcatctctatttcctgggaggtgtttatccaagtgcaataggaggtattggtgaccgcacagtcccctcagtgttctgctagtaaatagttgaaggttgatcattgatcttctgcgttttcagtctggcatggaaaagcccctgtgcaactggtaaagatatcaataagcaccaggaggtatctaaatccaccaggagccataggcatcacgttgacgtccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaaaaaaagtccgggcttgatggctcacacctgtaatcccagcactttgggaggccaagacgggtggatcacgaggtcaggagttcaagaccagcctggcctagatggtgaaaccctgtctctactaaaactacaaatattagctgggcatggtggcatgcacctgtaatctcagctactcagaagtctgatgcaggagaattgctaaaaccgaggagggagaggttgcagtgagccgagattgcaccactgcactctagcctgggcgacagagcaagactccgtctcgaaagaaagaaagaaagaaaggaaattccccagggaagtacctcggctgatttcataaacaggtaccgaaggaagcagaggcatgtggaggacttccccacctcatgcagctatttgggccgtggcgtctgaaatttattatttcagagtcacccctttgatgaccttggcagtgaactgcagtcatctgtttaggcctttccatggcccacgtcaatgccgttatttctgtttgttgcacatttgatttccttgttgttggcatttagaaggccccctgcttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcacttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggtcactgtactccagcctgggtgacagagcaagactccgtctcaaaaaaaaaaaaaagagaaagaaagtatcatgcttttctgcattctgtgaattgttttagtgagttatcgaacttgagggcatggtgggaacctccaaatttgcagccagttggtgagaagtacatgtggtctgaggacacccaagcctgcaggtgtgtgtgtgtggcggggatagggtgtccccacatgaggtatcttcctgaaagtgttactttccttgaagactttttgggaaaaaagttgggggggatttttggctagaaagtctgttcttctgctctgagctggctgctacccagcttgggcatgaggctagaccctcacactgccttcacaatg

SEQ ID NO: 408195 - DNA, 2731 bp, Homo sapiens
  misc_feature (158)..(158): n is a, c, g, or t
gcaagactccgtctcaaaaaaaaaaaaaagagagagaaagtatcatgcttttctgcattctgtgaattgttttagtgagttatcgaacttgagggcatggtgggaactccaaatttgcagccagttggtgagaagtacatgtggtctgaggacacccnagcctgcaggtgtgtctaaagcgagggcagcctagtggggactggtggccttaacctgtggcatttgaggtaacatcagggagttgacatcagaattgcatcacataggctgggcacggtggctcatgcctgtaatcccagcactttgggaggccaaggtgggtggatcacctgaggtcaggagttcgagaccagcctggccaacatggtgaaaccccgtctctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacgtccatttaccagtcttccctggcaagattcttctgaattgtgctgccttggccaaaagaggtatgggaggggctgggcgcagtggcttgtgcctgtaatcccaacattttgggaaaccaattcaggtggatcgttagaggtcaggggttcaagaccatcctggccaacatggtgacatcccatctctactaaaaatacaataagttagctgggtttggtgttgggtgcctgtaatcccagctactcgagaggctgaggcaggataatcgcttgaacctgggaggaggaggtggcagtgagctgagatcgtgccattgcactccagcgtgggcaacaagagtgaaacgtcgtctcaaaaaataaaaaaaaagtccgggcttgatggctcacacctgtaatcccagcactttgggaggccaagacgggtggatcacgaggtcaggagttcaagaccagcctggcctagatggtgaaaccctgtctctactaaaactacaaatattagctgggcatggtggcatgcacctgtaatctcagctactcagaagtctgatgcaggagaattgctaaaaccgaggagggagaggttgcagtgagccgagattgcaccactgcactctagcctgggcgacagagcaagactccgtctcgaaagaaagaaagaaagaaaggaaattccccagggaagtacctcggctgatttcataaacaggtaccgaaggaagcagaggcatgtggaggacttccccacctcatgcagctatttgggccgtggcgtctgaaatttattatttcagagtcacccctttgatgaccttggcagtgaactgcagtcatctgtttaggcctttccatggcccacgtcaatgccgttatttctgtttgttgcacatttgatttccttgttgttggcatttagaaggccccctgcttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcacttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggtcactgtactccagcctgggtgacagagcaagactccgtctcaaaaaaaaaaaaaagagaaagaaagtatcatgcttttctgcattctgtgaattgttttagtgagttatcgaacttgagggcatggtgggaacctccaaatttgcagccagttggtgagaagtacatgtggtctgaggacacccaagcctgcaggtgtgtgtgtgtggcggggatagggtgtccccacatgaggtatcttcctgaaagtgttactttccttgaagactttttgggaaaaaagttgggggggatttttggctagaaagtctgttcttctgctctgagctggctgctacccagcttgggcatgaggctagaccctcacactgccttcacaatg

SEQ ID NO: 408196 - DNA, 457 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccgtccccaaagcacagctgtgcttggggaacggcggccaagccccagcagcttgctgtccccacaaaggtaactcgggggagagcacctttggtgggtttgtggcgcaccaggttccttgtccagggtgggctctcgtcg

SEQ ID NO: 408197 - DNA, 1532 bp, Homo sapiens
  misc_feature (158)..(158): n is a, c, g, or t
  misc_feature (1414)..(1414): n is a, c, g, or t
  misc_feature (1427)..(1427): n is a, c, g, or t
  misc_feature (1436)..(1436): n is a, c, g, or t
  misc_feature (1442)..(1442): n is a, c, g, or t
  misc_feature (1461)..(1461): n is a, c, g, or t
  misc_feature (1467)..(1467): n is a, c, g, or t
  misc_feature (1483)..(1483): n is a, c, g, or t
gcaagactccgtctcaaaaaaaaaaaaaagagagagaaagtatcatgcttttctgcattctgtgaattgttttagtgagttatcgaacttgagggcatggtgggaactccaaatttgcagccagttggtgagaagtacatgtggtctgaggacacccnagcctgcaggtgtgtctaaagcgagggcagcctagtggggactggtggccttaacctgtggcatttgaggtaacatcagggagttgacatcagaattgcatcacataggctgggcacggtggctcatgcctgtaatcccagcactttgggaggccaaggtgggtggatcacctgaggtcaggagttcgagaccagcctggccaacatggtgaaaccccgtctctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatgtcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactagacggggtttttccacattggtcaggctggtctcaaacttctgacctcagatgatccgcccaccttggccacccaaagtgctgggattacaggtgtgaaccactgcgcccggccagaagtttttcttgaggaactaccctgccctgacagaggctggggatgaaggaggaagagacagccggtcccctggataaagaggtgagggggtgtgaagtctgggagcccccctcccagggccaggctacagggggacagcagggctataccaggagtgccacagagcttgcatttgggtgtgatctaatccccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttncccagggtggggnctgagaatntgaganccttgagcctgggaggtcnaggccncagtgagctatgatcncaccactgcactccagcctgggcgaaagagtgagaccctgcccccccaa

SEQ ID NO: 408198 - DNA, 816 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatccgtaagtttcccgtcacaggctctcaggggctgtgtttaatgggcccccctgggcaaagcacaagttccaagtcttcctcagtctctctgagctacaggaagtccttctgggggcttgctctgggcattttataatcttggtacctttttatcaaaatgacaccgacctccatgtcttcacataagccacacttctgtagtggcttattctgtagatgaacatgtgcatttacattcactgtttgtttgtttgtttttgagatggaattttctctctttgttgcccaggctggagtgcaatggcaacgatcttggctcactgaaacctcggcctcccgggttcaagtaattctcctcttcagccttcctagtagctgggaaattctagtcattcattcactcactcattcattcattcatgaataaacagtttgccctgcatgtgtacctggccccctcctgggcggatacggcaggcaaacggtgcaagggcggctgccgggagaaggtgggcagctggagtgggactgggggagacaggatcaatgtgacctgcggtggtccccaggtggccgggatgcagtacctgca

SEQ ID NO: 408199 - DNA, 308 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatctggcactatcaaatagtaggtctcattcattcttcctatttttttgtatccattaatcctcatttcctcccctgccagcaccc

SEQ ID NO: 408200 - DNA, 487 bp, Homo sapiens
gtaatattactagtgaattcactagtaatattactagtgaattcactagtaatacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcggaagagacctgga

SEQ ID NO: 408201 - DNA, 371 bp, Homo sapiens
gaagaaactcaatgaagcggcggggcgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagtgtctgcttggggatcctctaaatcgcgtaga

SEQ ID NO: 408202 - DNA, 787 bp, Homo sapiens
tacccgtttgtctgatggagatcggggtgcggagatgctgtgtggccgcaagatgaagctgaagcggacggcgagtgtcgctcgtgctcgctgagcaccacgaggccttcaacaggctgattggtatggaggacaccccagagagcacctccaatcctgttctttccaaaaacaggaaacttccagtaagcatacttttccaatggggaacgtaggccccaaatgggtgagctctccatgtgggaggaatgtgaagtgatcactcatgagggacacttaggagatgataaaggattaggtcaacttgataaaggtcagcgcttgggataagaaagcttggtttcgggccaggcgcagtggcacccgcctgtgattccagctacttgggaggctgaggcaggaagatagcctgaacccaggagttggaggctgcagtgaactatgatcacaccactgcactccagcctgggctacagagtgagaccctgtctcttaaaaaaaaaaaaaaaaccgggcatggtggtgggcacctgtaatcctagctacttgggaggctgaggcaggagaatcgcttgaacccaggaggcggtggttgtagtgagctaggatcatgccattgcagtccagcctggacagcaaagctagactccatctcaaaaaagaaaagaaaaagtaaaaaatttaaaaattagatgggcatggtgacatgtgcctgtaatcccaggtactaaggaagctgaggtaggaggatgacttgagcctaggagttcgaggctgcagtgagctc

SEQ ID NO: 408203 - DNA, 1490 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408204 - DNA, 2837 bp, Homo sapiens
  misc_feature (503)..(503): n is a, c, g, or t
  misc_feature (801)..(801): n is a, c, g, or t
  misc_feature (830)..(830): n is a, c, g, or t
  misc_feature (1055)..(1055): n is a, c, g, or t
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactagacggggtttttccacgttggtcnggctggtctcaaacttctgacctcagatgatccgcccaccttggccacccaaagtgctgggattacaggtgtgaaccactgcgcccggccagaagtttttcttgtgagttgaggtgaacatctgaatcccctcggggaactgaggaggaggaactaccctgccctgacagaggctggggatgaaggaggaagagacagccggtcccctggataaagaggtgagggggtgtgaagtctgggagcccccctcccagggccaggctacagggggacagcagggctataccaggagtgccanagagcttgcatttgggtgtgatctaatcnccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttccccagggtggggnctgagaatctgagaaccttgagcctgggaggtcaaggcctgcagtggtgccatcttggctcactgcagcctcaacctcgctcgagtgatcctcccacctcaggtcctaaaggaagagtcgctacattggggactgtttggacaaggagatccacggggtagacttagcgggattgtccctggggcagcctggatcctgaggctgccccgcctccttcctcagcccctccctggtcaggcgctcctggtgggtggggggggtagtccaggcttgtcttgcaactgtatgttctcttcagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408205 - DNA, 2205 bp, Homo sapiens
  misc_feature (503)..(503): n is a, c, g, or t
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactagacggggtttttccacgttggtcnggctggtctcaaacttctgacctcagatgatccgcccaccttggccacccaaagtgctgggattacaggtgtgaaccactgcgcccggccagaagtttttcttgtgagttgaggtgaacatctgaatcccctcggggaactgaggaggaggaactaccctgccctgacagaggctggggatgaaggaggaagagacagccggtcccctggataaagagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408206 - DNA, 2954 bp, Homo sapiens
  misc_feature (782)..(782): n is a, c, g, or t
  misc_feature (944)..(944): n is a, c, g, or t
  misc_feature (973)..(973): n is a, c, g, or t
  misc_feature (1198)..(1198): n is a, c, g, or t
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatccgtaagtttcccgtcacaggctctcaggggctgtgtttaatgggcccccctgggcaaagcacaagttccaagtcttcctcagtctctctgagctacaggaagtccttctgggggcttgctctgggcattttataatcttggtacctttttatcaaaatgacaccgacctccatgtcttcacataagccacacttctgtagtggcttattctgtagatgaacatgtgcatttacattcactgtttgtttgtttgtttttgagatggaattttctctctttgttgcccaggctggagtgcaatggcaacgatcttggctcactgaaacctcggcctcccgggttcaagtaattctcctcttcagccttcctagtagctgggactacaggcccacgccacgatgcccggctaatttttgtgtttttagtagagatggggattcactgtgttggccaggctggtctcgaactcctgacctcaggtgatccacctgccggcttcccaaagtgctgggattacaggcgtgagccaccatgcctggacttccatctggtaattntctgtctcgaggaggaactaccctgccctgacagaggctggggatgaaggaggaagagacagccggtcccctggataaagaggtgagggggtgtgaagtctgggagcccccctcccagggccaggctacagggggacagcagggctataccaggagtgccanagagcttgcatttgggtgtgatctaatcnccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttccccagggtggggnctgagaatctgagtgcagtggtgccatcttggctcactgcagcctcaacctcgctcgagtgatcctcccacctcaggtcctaaaggaagagtcgctacattggggactgtttggacaaggagatccacggggtagacttagcgggattgtccctggggcagcctggatcctgaggctgccccgcctccttcctcagcccctccctggtcaggcgctcctggtgggtggggggggtagtccaggcttgtcttgcaactgtatgttctcttcagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408207 - DNA, 2649 bp, Homo sapiens
  misc_feature (503)..(503): n is a, c, g, or t
  misc_feature (801)..(801): n is a, c, g, or t
  misc_feature (830)..(830): n is a, c, g, or t
  misc_feature (1055)..(1055): n is a, c, g, or t
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactagacggggtttttccacgttggtcnggctggtctcaaacttctgacctcagatgatccgcccaccttggccacccaaagtgctgggattacaggtgtgaaccactgcgcccggccagaagtttttcttgtgagttgaggtgaacatctgaatcccctcggggaactgaggaggaggaactaccctgccctgacagaggctggggatgaaggaggaagagacagccggtcccctggataaagaggtgagggggtgtgaagtctgggagcccccctcccagggccaggctacagggggacagcagggctataccaggagtgccanagagcttgcatttgggtgtgatctaatcnccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttccccagggtggggnctgagaatctgagtgcagtggtgccatcttggctcactgcagcctcaacctcgctcgagtgatcctcccacctcaggtcctaaaggaagagtcgctacattggggactgtttggacaaggagatccacggggtagacttagcgggattgtccctggggcagcctggatcctgaggctgccccgcctccttcctcagcccctccctggtcaggcgctcctggtgggtggggggggtagtccaggcttgtcttgcaactgtatgttctcttcagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408208 - DNA, 1269 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccagggtggggcgatcttgggtcaatgcaacctctgcctcagggttcaagcgattttcctgcttaagcctcctgagtagctgggactacaggcacacgccaccatgcccagctcattt

SEQ ID NO: 408209 - DNA, 1389 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctgaggcaggagaatcgcttgaacccaggaggcggtggttgtagtgagctaggatcatgccattgcagtccagcctggacagcaaagctagactccatctcaaaaaagaaaagaaaaagtaaaaaatttaaaaattagatgggcatggtgacatgtgcctgtaatcccaggtactaaggaagctgaggtaggaggatgacttgagcctaggagttcgaggctgcagtgagctc

SEQ ID NO: 408210 - DNA, 1521 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaaaagtaagtgacgccggctgcggagggccgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcagaaataaatgcccccaaaacctc

SEQ ID NO: 408211 - DNA, 655 bp, Homo sapiens
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgttggccacccctcaccctgacaccgacgtgtcctgtacatagattaggttttatattcctaataaagtatagcggaagagacctgga

SEQ ID NO: 408212 - DNA, 1067 bp, Homo sapiens
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcggaagagacctggatgtggacttgagcagcggtgacttcgcaagcaaatggattgtcaggcttgatgcaggcagatgacctgtttcaggggcgtccggctggcagggatgaattcattctggaccaaagatccggggtccaggggctgctgcgggggctgtgctgagccggagagaagtgtgcaaacccatgagctcccaagagtctctgctctagaagcctcaactcctgggcctgcctgtcagtcaaagcaggaacacttcttcctgcataactcgaaacacctttccacaggcttcttgtccacagtagagtttaataaaaatattcactgaaagaccccccccacccccatcggcccaaagctgaataagttagttagctgtgtccctggtcctttgcgatggtgtgaggctacatcctcccccagatggctacgatgttggagtccgtcag

SEQ ID NO: 408213 - DNA, 1889 bp, Homo sapiens
  misc_feature (503)..(503): n is a, c, g, or t
  misc_feature (801)..(801): n is a, c, g, or t
  misc_feature (830)..(830): n is a, c, g, or t
  misc_feature (1055)..(1055): n is a, c, g, or t
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactagacggggtttttccacgttggtcnggctggtctcaaacttctgacctcagatgatccgcccaccttggccacccaaagtgctgggattacaggtgtgaaccactgcgcccggccagaagtttttcttgtgagttgaggtgaacatctgaatcccctcggggaactgaggaggaggaactaccctgccctgacagaggctggggatgaaggaggaagagacagccggtcccctggataaagaggtgagggggtgtgaagtctgggagcccccctcccagggccaggctacagggggacagcagggctataccaggagtgccanagagcttgcatttgggtgtgatctaatcnccagtcctgccctgacctcctgggtgctcttagccaagccctcttccctgtgtgtgctagaaagtgagggtcactcccttccacacaagggagtgaattgagggtggggatctgagctctctgagcagcaaagctggacacaggccaaattgccaatcctgagtccctctgtcatgtggacctgggaagcttgtcctcatcctccatccttccccagggtggggnctgagaatctgagtgcagtggtgccatcttggctcactgcagcctcaacctcgctcgagtgatcctcccacctcaggtcctaaaggaagagtcgctacattggggactgtttggacaaggagatccacggggtagacttagcgggattgtccctggggcagcctggatcctgaggctgccccgcctccttcctcagcccctccctggtcaggcgctcctggtgggtggggggggtagtccaggcttgtcttgcaactgtatgttctcttcagacccctccctggcgatgccagattcactgggctggcagattctgcccccaaacctgtccaaccagttgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagagtgtctgttcttggggatccttagagtg

SEQ ID NO: 408214 - DNA, 1195 bp, Homo sapiens
cgacccctcctcagcagacgcaggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcggacgtgcctgcttccccttcgccttctgccgtgattgtcagtttcctgaggcctccccagccacgcttcctgtacagcctgcagaactgaggaggaactaccctgccctgacagaggctggggatgaaggaggaagagacagccggtcccctggataaagaggcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagtacagggtgaagttctggtgatgatgacgaaggaccgtggtgaaacagtggtccaggaaactcgctgtaggagccagggactcgggtgtccgggccagaacgggcgggcacatcgcccgttatcccggg

SEQ ID NO: 408215 - DNA, 988 bp, Homo sapiens
  misc_feature (750)..(750): n is a, c, g, or t
  misc_feature (812)..(814): n is a, c, g, or t
  misc_feature (826)..(827): n is a, c, g, or t
  misc_feature (829)..(829): n is a, c, g, or t
  misc_feature (835)..(835): n is a, c, g, or t
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgtctcaaagaaacaaaaataaaaaataaataaataaataaataagaaaacgcaacaaagaacagaagaggactccacaggacttctttcagagcttcatagcagcatgaattcaacatcaggaattcaatgttgacgacanacagcaggatgggaggaagagtaagagcagcaaacggacacaaatcgcacgtggtggtcagnnntaacagaagggnnantcagtnctgggaggaagcgggaaaattccagagcacagggtgtcaatttcttgttttgtgaattcttcagagcctgctgggtggaaacttctcagggggtcgggaaatttcgaaaaaaaggttgtggggggggggctcgggcagtataggtattttgac

SEQ ID NO: 408216 - DNA, 1009 bp, Homo sapiens
ttgggtgtaacttacggctaggtacgaggctggtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagcgagctgtccctgctggaggagcgcttccggacgtgcctgcttccccttcgccttctgccgtgattgtcagtttcctgaggcctccccagccacgcttcctgtacagcctgcagaactgccccactcacctcctccaactcctctggggaaacccaagccctgcagctcatggaacagaagaagtggaaccgtcgtttctggaacaggactatctgagagcggttcttcctggccctcgagttcatggaacggtataactggaaccgacgcttacggagcaagggtatgcgagagcggttcttcctggccctcgggttcgtggaacggtataactggaaccgacgcttacggagcaagggtatgcgagagcggttcttcctggccctcgggttcatggaatggcctaactggaaccaacgcttacggagcaagggtatgcgagagcggttcttcctatacaggaagtggaagatgttttgtttggagtcctcgtcgtcctcctccatgtcattggccaggtagctgaggacagaaatcaggttgctgctcaggggcaccaccaggagaggcctccggctgaggtcagcttcccagagaggaaggtaagggaccgtccctagctcaggactggcacccacc

SEQ ID NO: 408217 - DNA, 766 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (601)..(602): n is a, c, g, or t
  misc_feature (608)..(608): n is a, c, g, or t
  misc_feature (616)..(616): n is a, c, g, or t
  misc_feature (618)..(618): n is a, c, g, or t
  misc_feature (622)..(622): n is a, c, g, or t
  misc_feature (629)..(629): n is a, c, g, or t
  misc_feature (635)..(635): n is a, c, g, or t
  misc_feature (643)..(646): n is a, c, g, or t
  misc_feature (648)..(648): n is a, c, g, or t
  misc_feature (650)..(650): n is a, c, g, or t
  misc_feature (655)..(655): n is a, c, g, or t
  misc_feature (661)..(662): n is a, c, g, or t
  misc_feature (664)..(664): n is a, c, g, or t
  misc_feature (666)..(666): n is a, c, g, or t
  misc_feature (673)..(673): n is a, c, g, or t
  misc_feature (680)..(680): n is a, c, g, or t
  misc_feature (683)..(683): n is a, c, g, or t
  misc_feature (686)..(686): n is a, c, g, or t
  misc_feature (695)..(695): n is a, c, g, or t
  misc_feature (704)..(704): n is a, c, g, or t
  misc_feature (714)..(714): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaacaaaaaaaaaaaaaaaaaaagggaaaaaaaaaaaaaaaaaaaaaaaaaaccttnngggccntttggccnantganttttaanttgggnaagctttnnnntngngcccnaatttnngncnaattggncaattcnccntanggggggcgnttaaaaatnaagggccggngtttaacagggggggaggggaaaaccggggggtcacaattaatggcttggaa

SEQ ID NO: 408218 - DNA, 736 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (594)..(594): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaacaaaaaaaaaaaaaaaaaaagggaaaaaaaaaaaaaataaaaaaaancaaaaaaaaaaaaaaaaattgtgggccgcttgggccaatggttttttaaattggagcagttttttgttggggccccattttgggcaactttggcaatttcgcctatggggaggggtttaaacattagtggcccggggtttaa

SEQ ID NO: 408219 - DNA, 731 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaaaaaaatttaattactaaaatattatataccataaacattttatcactttacaacttcccttccttatcttttacactacctatcttccccaaattacaacaaaaaaaactttttttcgcggggacaccacccggggccactttaaaaaggtcccaggttacccaagtttctggccccttttttaagggatggggccccccgtgccccctgctttgggacccccgcctttcc

SEQ ID NO: 408220 - DNA, 456 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (427)..(427): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggnggccccgggcagttaccaggtaccgagcc

SEQ ID NO: 408221 - DNA, 515 bp, Homo sapiens
ccacttcgatcgaagtgtgcacacttcgatcgcggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccgcgatcgaagtgtgcacacttcgatcgcggagaatgggggataggtgtatgaacatgagggtgttttctcgtgtgaatgagggttttatgttgttaatgtggtgggtgagtgagccccattgtgttgtggtaaatatgtagagggagtatagggctgtgactagtatgttgagtcctgtaagtaggagagtgatatttgatcaggagaacgtgttactacacagagtcttctcttta

SEQ ID NO: 408222 - DNA, 599 bp, Homo sapiens
ttaggccaacgagcccatttttttttcccccccttcttaaaacaactacatttattttgctcatgagtctgcaatttcagcagggacaactcatctctgctccacttggcattagctggggcagtttgaagcttcgaagtctccttcacttgtgtggttagtggttgatgctggctgttagctctgacctcagctgaggctgtggctggaatgccgacatgtggcctttccttgtagatgcttgattttctcacaacttggaggcatcctcgtggcatggctggcgtggtctgagtcttttagttgagtatgcgtgggcagtgccactgcagcaaagcccctcgatggagtagagttcctgccgcaaaggggaggaggtgggtcgcagaatgggctgactcggagggagtttttaattttggctttacctgcttctccgtaagatttcatgacttgttagccacttaactcttgctcgtaagcaatctgtgtaaaatttaaccccactttgtccccaggttgcgttggaaaatgctttttcaaaagagcaaggtttgcttttgataagcttcgaaagccccactgtttccctctggcct

SEQ ID NO: 408223 - DNA, 591 bp, Homo sapiens
  misc_feature (20)..(20): n is a, c, g, or t
  misc_feature (591)..(591): n is a, c, g, or t
gcttctgtttcttgctgcancaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatataaaaaaaatacaacctattcactatgcttttccaattggatgggggacaataggtgaagatgcacagctggcggccgaatttgggcttattgggccatttcgccttaggaggggggattaaan

SEQ ID NO: 408224 - DNA, 657 bp, Homo sapiens
tccgctcggacgaggtgtggcatatgagagtgcgcatgtgcaacacgtgttcccagccaaggggtccaagaagggcagcgtgtccatgaagaccttgtcaatgaatgggtggaagggggcacacaagtcctccaagctttgaggtggtcccgagcaggacggtcccgctcggacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggtccgagcggagtccgctcggacgatgttcttcatctggcgcctcaaggacgaggtcgacatggtgcccggctgcagcagcaaggggcacagggccccgatgcgtggagagatggggcgactcccggacgaaggctgcggcaggtgctggcaggtcaccgcatctgcgaggggaagaggacctctttttcaacactgcatgcaaagactgggctccttactcctggagcagcctggtccgagcgga

SEQ ID NO: 408225 - DNA, 700 bp, Homo sapiens
agcgggtttcttgcttgcagcaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcattcggcctgttgggcctaaacgattctagacttgagaaagttaatgcatgggttcgaaaattaggctaccttggccaattccccctaataaagagtcttttccaatccacctgccccaattttttaatgataggcatggtatatcctgggcgtcccaatttaattccttggcaaattccctttaagggttggattaaaccaaagggcccggaataaaccgcttc

SEQ ID NO: 408226 - DNA, 482 bp, Homo sapiens
tgctggtaccggtccccaagttcgttcaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408227 - DNA, 476 bp, Homo sapiens
agcgggtttcttgcttgcagcaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408228 - DNA, 323 bp, Homo sapiens
agaagattagcatggcccctgcgcaaggatgacacgcaaattcgtgaagcgaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggaccccccccccccaatcggactgccaaattctccggtttgccccgggatattatagaaaattatttgtatgaataatgaaaataaaacacacctcgtggca

SEQ ID NO: 408229 - DNA, 393 bp, Homo sapiens
  misc_feature (27)..(27): n is a, c, g, or t
  misc_feature (44)..(44): n is a, c, g, or t
  misc_feature (49)..(50): n is a, c, g, or t
tgcggtggggcctggcagcgagactgnacggattgttttaaganaatgnnagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggttgcgtatatagaaatatttgtatgaacta

SEQ ID NO: 408230 - DNA, 420 bp, Homo sapiens
atataaggctaggggcgggcgccgctcttttgtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacacaaaacaaacaatcgacatcaca

SEQ ID NO: 408231 - DNA, 726 bp, Homo sapiens
  misc_feature (484)..(484): n is a, c, g, or t
atataaggctaggggcgggcgccgctcttttgtttcttgctgcagcaacgcgagtgggagcaccaggatctcgggctcggaacgagactgcacattgttttaagaaaatggcagacaaaccagacatgggggaaatcgccagcttcgataaggccaagctgaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaanaaacaactgatctgattccccctctcactatataactcttcagcccctttcaaatacatggaaccactactttaacccaatgcctctttaaatcggtcaagcctaacgatccgactgcccaattgggactccattcgtcccattggcccttaaccatactcttctctctcaataggccgtgctttctaatccttacctctggctacaccctcgggggttcctctagttacatgttcttctgt

SEQ ID NO: 408232 - DNA, 516 bp, Homo sapiens
  misc_feature (457)..(457): n is a, c, g, or t
actagtccacggttggctggaggagcaaccgtggctgagcaagcagggaggcagcttaggaatgcctgtacggccccacctcccaccaacctcaggtcaggcaggtgggaggtgccagcccgggggctgtggccacactcaggaacacaggatcccaggaaagcagacagtggcaagcagcttcggggcggggctttcctgctctggaccactgacctctgatctctgaagaactttctgtcccacaagctagcgattgtggccaccacttacccagtactctctgtgccaggaaatacgctatcgtctcactgaattaatgagaaaacagagaccattgagcaggagaagcggagtgaaatttcctaagatcctggaggatttcctacccccgtcctcttcgagaccccagtcgtgatgtggaggaagagccacctgcaagatggacacgagcctnatcttggcgtgtgaatcttgtcgcatccgcgcctgatcgcatccttctctgcgcttggc

SEQ ID NO: 408233 - DNA, 477 bp, Homo sapiens
  misc_feature (4)..(4): n is a, c, g, or t
ggtnactctccaggattcgtccgctcggaccaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408234 - DNA, 693 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (581)..(581): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaaaaaaaacaaaaaaaaaaaaaaaaaaagggaaaaaaaaaaaaaaaaaaatagagaaaaaaaaaaanaaaaacgcccgaaattgggctaatttggcaatatccccttaggggggcggattaacaataagtgccgggttttacaacgcggaactgggcccttgcggtccccatttggctt

SEQ ID NO: 408235 - DNA, 1498 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaagagagggcgcgcgccgcgccccaagaagatccacccccgagaggggccccaggatctaacgcgcgctatcccccgagctataactccggcccaaaggggcccacgataaagagagcggcgcgaatctctaaacaagcatagcggacaaggggacaggacccacaaacaacaccggacaggcgaccagggcgcacaacccgagcgacacctgagggggcactccacacggccaaacacacacccacatcaacacacaaccggaagaccgcacaccatacaagggggccaaaccacaaccccaacaacgaacgctcccacacccccccacaaccggacacaccacacacacacccacacaccgctccacacaaggctgcaaacacacaccgaccccaccatcagaccaagacaaggaactacccccaaccccccgcccacaccccggcccaacacacagccacgcgaccccaaccaccaccacccccaggcgaccgaccccccacaccaacccccccgacaccacacaccacccccacccacaccccgcaccgcgcgccaccgcgccgcgcgccaggcgcccaaggcgcccgccggccagcgcaccccccgccgccggcgcccctccccgcccccgcgcccgcaccccccccccacgcgccccccaccaccccccggcccgaccaaggcgccgacgcgccgcgccccccccccccagcgccccccgccgccgcaccccccccccccaccccaccgccccaccggccccacccccgccgccggcgccccccccccaaaccccacaccccgccaccccccaccgcccgccaacgcgccccaccccagccgcgccgcgacgcccccccacccgcccccccgccgaacccggccggcccgacgccccacggcgaccagggccagccgcagcacgggcgccccacgagacaggcggacgcccgcgcgcacgaccgccccgcaccccccccggg

SEQ ID NO: 408236 - DNA, 703 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaatagagaaaaaaaaaaaattgggggaataatattggggggggggaaaaaggggtaaggaagtgggcccatggggcgaataggtggtttctgtgaccaagagtttctgtgtcaaggtgggaaatttggcagggtttccatattagggaggggggattaaattgaagaaaagccagggttaccctggattaatgaatggggaaaagc

SEQ ID NO: 408237 - DNA, 1339 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaaaaaaaaaaaaaaaaaaaaaaacagtgtgtgtgggcgcgcgccctgggccccttggaagaaagcctttcgagagaaccacattgcgcggtgtggggagcgcggcgggccccagggaaggaaagagtgcgaacacgatgggctccaagagcggtgttatccacatgagggaaactcgcgggccacgagagcacacaagaggcgcgagggaaaattcccccaccccaatataagaaacaagggcccgggggggaccaacgcgcgacggcgttctctgggaacaaaagatcccccaagagaggcgcgctacactggggagggcgccacataaaacggggggcgtcttatatctcaacaaagaggaggggagaccaaaagcgagagcgccaccaagaagaccctaccaatattaaagcgcccccgccgctccagggtgggaaacaccaacgacaggaaagaaaacaccaaaaaccaaacaacaaccacaccagaaaacacacaggcaacaacgaactagcccgaaaacaagaaaaaaaggaggcaacaacaaacacaacaggggacgaagctcacagcaaacagcagacaagcgcacacccacaaatacagccgggctacacagcgacgacccgaaaaacgggaagcagagacgccgggcggcacggcgagcgagagggggagggggacgggcaggggcagagaaggaggaaacagcaggacagagaaagccgcggacgagggtgagaagaagaaaagagaaaagcgggaactgagggacgaacggaggcgcgccggaggcaagaatgcggccgagcggaaaaggcggcgcgagtaaaacggca

SEQ ID NO: 408238 - DNA, 518 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcagcggccgcgaatttagtagtagtaggc

SEQ ID NO: 408239 - DNA, 583 bp, Homo sapiens
tccgctcggacgaggtgtggcatatgagagtgcgcatgtgcaacacgtgttcccagccaaggggtccaagaagggcagcgtgtccatgaagaccttgtcaatgaatgggtggaagggggcacacaagtcctccaagctttgaggtggtcccgagcaggacggtcccgctcggacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408240 - DNA, 437 bp, Homo sapiens
gcactccaagactcacggggccggaacgttaactgcccggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408241 - DNA, 503 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccacgaggtgtgttttattttcattattcatacaaataattttctataatatcccggggcaaaccggtcgacg

SEQ ID NO: 408242 - DNA, 777 bp, Homo sapiens
  misc_feature (20)..(20): n is a, c, g, or t
gcttctgtttcttgctgcancaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccgagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408243 - DNA, 846 bp, Homo sapiens
  misc_feature (65)..(65): n is a, c, g, or t
  misc_feature (71)..(71): n is a, c, g, or t
  misc_feature (89)..(89): n is a, c, g, or t
gagagagagagagagagagagagagagagagagagagagacagagagagagagagagagagagcngagagngaggagagagaggagggncaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccgagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408244 - DNA, 1000 bp, Homo sapiens
gtaccgctgccacgaagtgggagctggggttcctgtgtgcacgctgccctcacgaagtgggagctggggttcctgtgtgcacgctgccctcacgaagtgggagctggggttcctgtgtgcacgctgccttcaggaagtgggagctggggttcctgtgtgcacgctgccttcacaaagtgggagctggggttcctgtgtacacattgccttcacttcgtgggagcacttcgtgggcagcgctgccaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccgagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408245 - DNA, 419 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacacaaaacaaacaatcgacatcaca

SEQ ID NO: 408246 - DNA, 753 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (551)..(551): n is a, c, g, or t
  misc_feature (553)..(553): n is a, c, g, or t
  misc_feature (557)..(557): n is a, c, g, or t
  misc_feature (559)..(559): n is a, c, g, or t
  misc_feature (564)..(564): n is a, c, g, or t
  misc_feature (576)..(578): n is a, c, g, or t
  misc_feature (612)..(612): n is a, c, g, or t
  misc_feature (615)..(615): n is a, c, g, or t
  misc_feature (619)..(619): n is a, c, g, or t
  misc_feature (625)..(625): n is a, c, g, or t
  misc_feature (631)..(631): n is a, c, g, or t
  misc_feature (633)..(633): n is a, c, g, or t
  misc_feature (640)..(640): n is a, c, g, or t
  misc_feature (646)..(646): n is a, c, g, or t
  misc_feature (649)..(649): n is a, c, g, or t
  misc_feature (651)..(651): n is a, c, g, or t
  misc_feature (654)..(654): n is a, c, g, or t
  misc_feature (659)..(660): n is a, c, g, or t
  misc_feature (663)..(663): n is a, c, g, or t
  misc_feature (672)..(672): n is a, c, g, or t
  misc_feature (675)..(675): n is a, c, g, or t
  misc_feature (686)..(686): n is a, c, g, or t
  misc_feature (691)..(691): n is a, c, g, or t
  misc_feature (696)..(696): n is a, c, g, or t
  misc_feature (700)..(700): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaacaaaaaaaaaaaaaaaaaaagggaaaaaaaaaaaaacaaaaaaaancntgtngnccgcntgggccaagtgnnntttagactgagcaggtttatgcatgcggccgaanttngggntaattngcccantngccctangggggncgntntanaaatnnatngcccgcggnttnaaaacggcggnactgngaaancccnggggtaccaaatttattcgctttggagcacatcccccttttcgcaggtgggga

SEQ ID NO: 408247 - DNA, 345 bp, Homo sapiens
ccacttcgatcgaagtgtgcacacttcgatcgcggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408248 - DNA, 659 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (495)..(495): n is a, c, g, or t
  misc_feature (500)..(500): n is a, c, g, or t
  misc_feature (513)..(514): n is a, c, g, or t
  misc_feature (524)..(525): n is a, c, g, or t
  misc_feature (533)..(533): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaaaaaaaaaaaaaaaaanaaaanaaaaaaaaaaaanngaaaaaaaannaaaaaaanaaaaaagcggccgaatttcgggctcattgggcacaatccccttatagggagccggtttacatttcattgcccggcggtttaacaacgtgtaactggggaataccctgggtgtaccaaccttttgcc

SEQ ID NO: 408249 - DNA, 633 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaaaaaaaaaaaaaaaatttaatttaataattaatttaaataaaacaaatataatattcaaacatctcataataaaatttaaaaataaataaaaaaaaaatgcgggcgcaaattcggggctctattgggcctcgccccttatagggggggggattcc

SEQ ID NO: 408250 - DNA, 749 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatgggtgggacgacagtgaaatctagagtaaaaccaagctggcccaaggtgtactgcaggctagaatgcagtttaatcagaagtgccattattttttttgataaaatgatcttggtggccggcctgcgcccttttttttttatgcctaggaaaagtttttcatggggcccaaatttgggctttttgggccattccccttttgggggtggtttaaaaaaattggccggggtttcacaaggggggaggggaaaacccgggggtatccaaataaagccttggg

SEQ ID NO: 408251 - DNA, 506 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacgacaaaccagacatgggggaaatcgccagcttcgataaggccaagctgaagaaaacggagacgcaggagaagaacaccctgccgaccaaagagaccattgagcaggagcgcccgcttcccgctctccacagccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408252 - DNA, 725 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (483)..(483): n is a, c, g, or t
tcagctcggtaccnggnacttcntgtgggggtttcttgctgcagcaacgcgagtgggagcaccaggatctcgggctcggaacgagactgcacattgttttaagaaaatggcagacaaaccagacatgggggaaatcgccagcttcgataaggccaagctgaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaanaaacaactgatctgattccccctctcactatataactcttcagcccctttcaaatacatggaaccactactttaacccaatgcctctttaaatcggtcaagcctaacgatccgactgcccaattgggactccattcgtcccattggcccttaaccatactcttctctctcaataggccgtgctttctaatccttacctctggctacaccctcgggggttcctctagttacatgttcttctgt

SEQ ID NO: 408253 - DNA, 929 bp, Homo sapiens
  misc_feature (766)..(766): n is a, c, g, or t
  misc_feature (771)..(771): n is a, c, g, or t
  misc_feature (784)..(785): n is a, c, g, or t
  misc_feature (795)..(796): n is a, c, g, or t
  misc_feature (804)..(804): n is a, c, g, or t
gtaccgctgccacgaagtgggagctggggttcctgtgtgcacgctgccctcacgaagtgggagctggggttcctgtgtgcacgctgccctcacgaagtgggagctggggttcctgtgtgcacgctgccttcaggaagtgggagctggggttcctgtgtgcacgctgccttcacaaagtgggagctggggttcctgtgtacacattgccttcacttcgtgggagcacttcgtgggcagcgctgccaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaaaaaaaacaaaaaaaaaaaaaaaaaaagggaaaaaaaaaaaanaaaanaaaaaaaaaaaanngaaaaaaaannaaaaaaanaaaaaaaaaaaatggcggcccgcttggcccaatgttttttaaatttgggaaagtttttttttggggcccgatttggaggttttttgggcaattccccttaagggggagggtatattaatgccttg

SEQ ID NO: 408254 - DNA, 726 bp, Homo sapiens
gtaccgctgccacgaagtgggagctggggttcctgtgtgcacgctgccctcacgaagtgggagctggggttcctgtgtgcacgctgccctcacgaagtgggagctggggttcctgtgtgcacgctgccttcaggaagtgggagctggggttcctgtgtgcacgctgccttcacaaagtgggagctggggttcctgtgtacacattgccttcacttcgtgggagcacttcgtgggcagcgctgccaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcagcggccgcgaatttagtagtagtaggc

SEQ ID NO: 408255 - DNA, 934 bp, Homo sapiens
gtaccgctgccacgaagtgggagctggggttcctgtgtgcacgctgccctcacgaagtgggagctggggttcctgtgtgcacgctgccctcacgaagtgggagctggggttcctgtgtgcacgctgccttcaggaagtgggagctggggttcctgtgtgcacgctgccttcacaaagtgggagctggggttcctgtgtacacattgccttcacttcgtgggagcacttcgtgggcagcgctgccaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcattaaacaagttttaaactgggacaaacgtggtaggaacctaacttgaatggacttgaaaaaaccttgtccgtccgcctttgccccagtcgacttttaaattggaccaacctttatccatgctgcccgaatttggagctcaactggccaattcacccctatagggaggccgaataaacattcactggccggcggttaaccgtcgggacttggacccttgggcttacccactgtcgc

SEQ ID NO: 408256 - DNA, 468 bp, Homo sapiens
  misc_feature (20)..(20): n is a, c, g, or t
gcttctgtttcttgctgcancaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggaccccccccccccaatcggactgccaaattctccggtttgccccgggatattatagaaaattatttgtatgaataatgaaaataaaacacacctcgtggca

SEQ ID NO: 408257 - DNA, 715 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacgacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaacaaaaaataaccacccccacttctccatcccctcctcacacaacacggcaccaaaaatctctccactcaaaagacattgtcggccgccttgggcccattcgattttagaactggagccaagtttttgcattgcggcccgaaattcgagggtcatttgggccaaatttgcccctatagcggagccggattacttcacttgtccgggggttttaacaacggcgggttggg

SEQ ID NO: 408258 - DNA, 407 bp, Homo sapiens
  misc_feature (20)..(20): n is a, c, g, or t
  misc_feature (373)..(373): n is a, c, g, or t
  misc_feature (380)..(380): n is a, c, g, or t
  misc_feature (382)..(382): n is a, c, g, or t
gcttctgtttcttgctgcancaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggaccccnttaaacncncacagtcggggatcgttggcccaaa

SEQ ID NO: 408259 - DNA, 689 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (345)..(345): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctaccccccccccccaatcggactgccaaattctccggtttgccccgggatattatagaaaattatttgtatgaataatgaaaataaaacacacctcgtggcattgncaaaaaaacatacaatcaaaaaaccacaaacaacaaatctttttgtcggggccggcttacgggagccttagaaaaaaagtgttatctcaagacacgaactcgttgggggccgccgggcgccaagggatgtgtacctgtgcgacaacctggtcacaagcgctggcccaaaggagagacgccggtggacaaggcaataacgcggtgggtctccccaccaataaaaaaaccgccgcgggcggaaccccggcgggtctggaacgactccacgaggggatgcccgagggcgcacaacacggggtccaccaacgggggtccaggagcccgataaatacgcccgcggtggg

SEQ ID NO: 408260 - DNA, 319 bp, Homo sapiens
ttaggccaacgagcccatttttttttcccccccttcttaaaacaactacatttattttgctcatgagtctgcaatttcagcagggacaactcatctctgctccacttggcattagctggggcagtttgaagcttcgaagtctccttcacttgtgtggttagtggttgatgctggctgttagctctgacctcagctgaggctgtggctggaatgccgacatgtggcctttccttgtagatgcttgattttctcacaaactgagtgctcccaggttgtctggccggtgcggtggtgacccgctggcgttgcgtatggcgat

SEQ ID NO: 408261 - DNA, 491 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408262 - DNA, 755 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (601)..(602): n is a, c, g, or t
  misc_feature (608)..(608): n is a, c, g, or t
  misc_feature (616)..(616): n is a, c, g, or t
  misc_feature (618)..(618): n is a, c, g, or t
  misc_feature (622)..(622): n is a, c, g, or t
  misc_feature (629)..(629): n is a, c, g, or t
  misc_feature (635)..(635): n is a, c, g, or t
  misc_feature (643)..(646): n is a, c, g, or t
  misc_feature (648)..(648): n is a, c, g, or t
  misc_feature (650)..(650): n is a, c, g, or t
  misc_feature (655)..(655): n is a, c, g, or t
  misc_feature (661)..(662): n is a, c, g, or t
  misc_feature (664)..(664): n is a, c, g, or t
  misc_feature (666)..(666): n is a, c, g, or t
  misc_feature (673)..(673): n is a, c, g, or t
  misc_feature (680)..(680): n is a, c, g, or t
  misc_feature (683)..(683): n is a, c, g, or t
  misc_feature (686)..(686): n is a, c, g, or t
  misc_feature (695)..(695): n is a, c, g, or t
  misc_feature (704)..(704): n is a, c, g, or t
  misc_feature (714)..(714): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaacaaaaaaaaaaaaaaaaaaagggaaaaaaaaaaaaaaaaaaaaaaaaaaccttnngggccntttggccnantganttttaanttgggnaagctttnnnntngngcccnaatttnngncnaattggncaattcnccntanggggggcgnttaaaaatnaagggccggngtttaaggtcgaacgggccctgtgggtccccattttgcttt

SEQ ID NO: 408263 - DNA, 652 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcataaaacacaccttcgtgggaaaatctttctcttctacctattaacctttgtcggcctcttgggccaagtggatttttaactcggccaatcttatccctaggggccgaattttggattaccttggcaaattcccccttataggggagcggtttacttgggcg

SEQ ID NO: 408264 - DNA, 415 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcacttcccgggcgggccccccccccggggggaaaaattttttggggggacccccccccccccaaaactgccaaattctccggtt

SEQ ID NO: 408265 - DNA, 531 bp, Homo sapiens
attatgaaggagaacttcccctacttccgtagtgcctgtgacgattagggctcagattacctctccgatgtctttgagtttaaggtacaaggatgaggattagaagattgatttttctgagtttctgtccttgtctgggagacatagccacagacgtacctctagcagagccatggaagcagcgccctgttccgggggcagccaatgacccagccccaccaatgggcctccagagaccccaggtaccataaaatgctcttctccgcgatcgaagtgtgcacacttcgatcgcttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccgcgatcgaagtgtgtaatacctcgag

SEQ ID NO: 408266 - DNA, 783 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (552)..(552): n is a, c, g, or t
  misc_feature (554)..(554): n is a, c, g, or t
  misc_feature (558)..(558): n is a, c, g, or t
  misc_feature (560)..(560): n is a, c, g, or t
  misc_feature (565)..(565): n is a, c, g, or t
  misc_feature (577)..(579): n is a, c, g, or t
  misc_feature (613)..(613): n is a, c, g, or t
  misc_feature (616)..(616): n is a, c, g, or t
  misc_feature (620)..(620): n is a, c, g, or t
  misc_feature (626)..(626): n is a, c, g, or t
  misc_feature (632)..(632): n is a, c, g, or t
  misc_feature (634)..(634): n is a, c, g, or t
  misc_feature (641)..(641): n is a, c, g, or t
  misc_feature (647)..(647): n is a, c, g, or t
  misc_feature (650)..(650): n is a, c, g, or t
  misc_feature (652)..(652): n is a, c, g, or t
  misc_feature (655)..(655): n is a, c, g, or t
  misc_feature (660)..(661): n is a, c, g, or t
  misc_feature (664)..(664): n is a, c, g, or t
  misc_feature (673)..(673): n is a, c, g, or t
  misc_feature (676)..(676): n is a, c, g, or t
  misc_feature (687)..(687): n is a, c, g, or t
  misc_feature (692)..(692): n is a, c, g, or t
  misc_feature (697)..(697): n is a, c, g, or t
  misc_feature (701)..(701): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaatccatagaatgactaaaaaaacgcaacaaaaaaaancntgtngnccgcntgggccaagtgnnntttagactgagcaggtttatgcatgcggccgaanttngggntaattngcccantngccctangggggncgntntanaaatnnatngcccgcggnttnaaaacggcggnactgngaaancccnggggtaacccaactttaaagcctttggaacaaattcccctttttgccaagtgggataccgggcgcccaacacggcgctttac

SEQ ID NO: 408267 - DNA, 781 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (504)..(504): n is a, c, g, or t
  misc_feature (557)..(557): n is a, c, g, or t
  misc_feature (566)..(566): n is a, c, g, or t
  misc_feature (568)..(568): n is a, c, g, or t
  misc_feature (572)..(574): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaataaaaaaaancaaaaaaaaaaaaaaaaattgtgggggggctgggcctagaaaaaaatttttanaaccatcgntngggnnngggggccaagaggataaggggaaacctggggcaaacccggtgcccaaggaaaccggtccagcacacgggtgggtttctcccataaaaaacgccgcgggaccggcttccgaacacaccagaggatccgagcaacagggccaaacgggcaggatcaattacggccgggggtgacccgagaacgaaacaccaaagaaccaacagacaccc

SEQ ID NO: 408268 - DNA, 774 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacgtgagtgcggcgccggggcggggggcccacccagggtgtggtcggatccggtgcaccgggcgggcgcgccgcaaccgcgacaggcgcccttctcggaccggacgcaggggccggcgaccacgccctgggaccgagaagaggggtgcgggacgcgcccagatcctcggccttggggctgctcggcacgccttggcgcgagtgccacgtcgagaggcgtcggcggggagcgcggaaggggacgctggcccccaggcccaggtcaagcgccttggtttgcccactaggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408269 - DNA, 661 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccgcgatcgaagtgtgcacacttcgatcgcggagaatgggggataggtgtatgaacatgagggtgttttctcgtgtgaatgagggttttatgttgttaatgtggtgggtgagtgagccccattgtgttgtggtaaatatgtagagggagtatagggctgtgactagtatgttgagtcctgtaagtaggagagtgatatttgatcaggagaacgtgttactacacagagtcttctcttta

SEQ ID NO: 408270 - DNA, 449 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccgcgatcgtaagcggggcgagctcaa

SEQ ID NO: 408271 - DNA, 470 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408272 - DNA, 1038 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (884)..(885): n is a, c, g, or t
  misc_feature (891)..(891): n is a, c, g, or t
  misc_feature (899)..(899): n is a, c, g, or t
  misc_feature (901)..(901): n is a, c, g, or t
  misc_feature (905)..(905): n is a, c, g, or t
  misc_feature (912)..(912): n is a, c, g, or t
  misc_feature (918)..(918): n is a, c, g, or t
  misc_feature (926)..(929): n is a, c, g, or t
  misc_feature (931)..(931): n is a, c, g, or t
  misc_feature (933)..(933): n is a, c, g, or t
  misc_feature (938)..(938): n is a, c, g, or t
  misc_feature (944)..(945): n is a, c, g, or t
  misc_feature (947)..(947): n is a, c, g, or t
  misc_feature (949)..(949): n is a, c, g, or t
  misc_feature (956)..(956): n is a, c, g, or t
  misc_feature (963)..(963): n is a, c, g, or t
  misc_feature (966)..(966): n is a, c, g, or t
  misc_feature (969)..(969): n is a, c, g, or t
  misc_feature (978)..(978): n is a, c, g, or t
  misc_feature (987)..(987): n is a, c, g, or t
  misc_feature (997)..(997): n is a, c, g, or t
tcagctcggtaccnggnacttcntgtgggggtttcttgctgcagcaacgcgagtgggagcaccaggatctcgggctcggaacgagactgcacgtgagtgcggcgccggggcggggggcccacccagggtgtggtcggatccggtgcaccgggcgggcgcgccgcaaccgcgacaggcgcccttctcggaccggacgcaggggccggcgaccacgccctgggaccgagaagaggggtgcgggacgcgcccagatcctcggccttggggctgctcggcacgccttggcgcgagtgccacgtcgagaggcgtcggcggggagcgcggaaggggacgctggcccccaggcccaggtcaagcgccttggtttgcccactaggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaaaaaaaaaaaaaaaaaaaaaaaaaaaaaaaaacaaaaaaaaaaaaaaaaaaagggaaaaaaaaaaaaaaaaaaaaaaaaaaccttnngggccntttggccnantganttttaanttgggnaagctttnnnntngngcccnaatttnngncnaattggncaattcnccntanggggggcgnttaaaaatnaagggccggngtttaaggtcgaacgggccctgtgggtccccattttgcttt

SEQ ID NO: 408273 - DNA, 878 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaaaaaaaaaaaaaaaaaaaaaaaaaacaaaaaaaaaaaaaaaaaaagggaaaaaaaaaaagggggggcaaaaaaattccccggggggggccacaagtataagggcacaccccaaggtattgtggtgcaaaagggggggccccaaataaggagcgagccgcgataaaataagacgacaagagaacggagacagagccgacgggtcattataaaacaaagagcgcggcatcgacgtgagggggaacaaaccgcgggccacagcagggagggacaaccactgggcgaaagaggaacaccaccgcaacacgagcgggggggggggggccaacaatttgggggcccacaccaacgccgccagagaggacgatttgaaacgcgccgcgacgagggacagcaactaac

SEQ ID NO: 408274 - DNA, 787 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaagacgaaaaaaggggcggccagggccggggggcctccatgatccaccccaacgtgccggccatcatgatcgcgcccatgtgcccccaatcgctgtccttccggcccatcgtgggtccccgcaggggtcagagctgaagatcatgctgtcaccggaagcagggaacacagcatgggtgctccttggatggaccggaagagacaagagatccgccagggagaccagcatcagcatcaataccctcatgctacccattccgctccatctgtgtgcggggaccctgtgagcgactgggtttgaaagcctcgca

SEQ ID NO: 408275 - DNA, 699 bp, Homo sapiens
gtaccgctgccacgaagtgggagctggggttcctgtgtgcacgctgccctcacgaagtgggagctggggttcctgtgtgcacgctgccctcacgaagtgggagctggggttcctgtgtgcacgctgccttcaggaagtgggagctggggttcctgtgtgcacgctgccttcacaaagtgggagctggggttcctgtgtacacattgccttcacttcgtgggagcacttcgtgggcagcgctgccaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggca

SEQ ID NO: 408276 - DNA, 943 bp, Homo sapiens
  misc_feature (923)..(923): n is a, c, g, or t
gtaccgctgccacgaagtgggagctggggttcctgtgtgcacgctgccctcacgaagtgggagctggggttcctgtgtgcacgctgccctcacgaagtgggagctggggttcctgtgtgcacgctgccttcaggaagtgggagctggggttcctgtgtgcacgctgccttcacaaagtgggagctggggttcctgtgtacacattgccttcacttcgtgggagcacttcgtgggcagcgctgccaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcaaaaaaaaaaaaaaaaaaaaaaaaaacaaaaaaacaatactaaattaccatactcataacatactataaaaaactcataaataaaaaaaaaacttgtggcccgcttgggccaaatggcctttagcctcgagcaagcttatcaatgcggccgaaattcgggttaattgtgccatttggccttattgggagcggatttacaattcgtgcccggtgtttaccaccttncctggacctctggttacccc

SEQ ID NO: 408277 - DNA, 600 bp, Homo sapiens
  misc_feature (14)..(14): n is a, c, g, or t
  misc_feature (17)..(17): n is a, c, g, or t
  misc_feature (23)..(23): n is a, c, g, or t
tcagctcggtaccnggnacttcntgtgggggtttcttgctgcagcaacgcgagtgggagcaccaggatctcgggctcggaacgagactgcacgacaaaccagacatgggggaaatcgccagcttcgataaggccaagctgaagaaaacggagacgcaggagaagaacaccctgccgaccaaagagaccattgagcaggagttgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggaaaaaacaccccccctcctctcctctattctccactctctatttactccaacaggggaaagggaacatccaatctcactacctcataacatggggcccaaatctcgggctttggcct

SEQ ID NO: 408278 - DNA, 497 bp, Homo sapiens
  misc_feature (421)..(421): n is a, c, g, or t
  misc_feature (425)..(425): n is a, c, g, or t
  misc_feature (427)..(427): n is a, c, g, or t
  misc_feature (431)..(431): n is a, c, g, or t
  misc_feature (463)..(463): n is a, c, g, or t
  misc_feature (465)..(465): n is a, c, g, or t
gtaccgctgccacgaagtgggagctggggttcctgtgtgcacgctgccctcacgaagtgggagctggggttcctgtgtgcacgctgccctcacgaagtgggagctggggttcctgtgtgcacgctgccttcaggaagtgggagctggggttcctgtgtgcacgctgccttcacaaagtgggagctggggttcctgtgtacacattgccttcacttcgtgggagcacttcgtgggcagcgctgccaacgcgagtgggagcaccaggatctcgggctcggaacgagactgcacattgttttaagaaaatggcagacaaaccagacatgggggaaatcgccagcttcgataaggccaagctgaagaaaacggagacgcaggagaagaacaccctgccgaccaaagagaccattgagcaggagcnagcngngtgnccatttcctaagcatcctagttccagcctggncnaaaaaagaaaactctgcctcaaaaaaaaaaaa

SEQ ID NO: 408279 - DNA, 3406 bp, Homo sapiens
cgagcctcctgttcattagcagttgagaaaaattcctttctagtttgatcaatccttgttttcctcggcagagcccgggcgcccgcccagcgcggagacgggcgcgcggggtctctccgcggcgggggcgccgggcctcgggggagcgcagaagtagccgcccgggggtcaggccggagcgccgccggggcttctccctccctccctcgccggttgcctttttttccacttctctccctcccccttccgtttctatttgtgaagggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgcagcccgctgcgcgcgcggcgtgaggaccgcggctccctcctccggggggcgggcacgcggaaggcgctgctgactgagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataat

SEQ ID NO: 408280 - DNA, 3714 bp, Homo sapiens
cgagcctcctgttcattagcagttgagaaaaattcctttctagtttgatcaatccttgttttcctcggcagagcccgggcgcccgcccagcgcggagacgggcgcgcggggtctctccgcggcgggggcgccgggcctcgggggagcgcagaagtagccgcccgggggtcaggccggagcgccgccggggcttctccctccctccctcgccggttgcctttttttccacttctctccctcccccttccgtttctatttgtgaagggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgcagcccgctgcgcgcgcggcgtgaggaccgcggctccctcctccggggggcgggcacgcggaaggcgctgctgactgagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtcccactccctgcctcgcctgttcccctatcccccccaggcctgggatcttcaggcgtcggtgtggggaggggcccctgccctccttgccttga

SEQ ID NO: 408281 - DNA, 2072 bp, Homo sapiens
tcccacccaaatgtccctgcagaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtccca

SEQ ID NO: 408282 - DNA, 3007 bp, Homo sapiens
cgagcctcctgttcattagcagttgagaaaaattcctttctagtttgatcaatccttgttttcctcggcagagcccgggcgcccgcccagcgcggagacgggcgcgcggggtctctccgcggcgggggcgccgggcctcgggggagcgcagaagtagccgcccgggggtcaggccggagcgccgccggggcttctccctccctccctcgccggttgcctttttttccacttctctccctcccccttccgtttctatttgtgaagggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgcagcccgctgcgcgcgcggcgtgaggaccgcggctccctcctccggggggcgggcacgcggaaggcgctgctgactgagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactcctacctatctccccttttatactaataatcttat

SEQ ID NO: 408283 - DNA, 1820 bp, Homo sapiens
tccaggctttgccacttgtagctgtgggacagtgggtaagcaacatgacctccccagcctccatttcttcagcttaaagtggggatataactattctgtacctcctaatggtagaggagcaagcatcacctgagatgtaacattcttgggcctctaggtgtcaatggtccccaggtccaacccagggagaggaggcctgggttgcttggggtgggagctttggcgacttttgccccaactctccacaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtccca

SEQ ID NO: 408284 - DNA, 2275 bp, Homo sapiens
cgagcctcctgttcattagcagttgagaaaaattcctttctagtttgatcaatccttgttttcctcggcagagcccgggcgcccgcccagcgcggagacgggcgcgcggggtctctccgcggcgggggcgccgggcctcgggggagcgcagaagtagccgcccgggggtcaggccggagcgccgccggggcttctccctccctccctcgccggttgcctttttttccacttctctccctcccccttccgtttctatttgtgaagggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgcagcccgctgcgcgcgcggcgtgaggaccgcggctccctcctccggggggcgggcacgcggaaggcgctgctgactgagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcggctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtccca

SEQ ID NO: 408285 - DNA, 2028 bp, Homo sapiens
  misc_feature (2018)..(2019): n is a, c, g, or t
cgagcctcctgttcattagcagttgagaaaaattcctttctagtttgatcaatccttgttttcctcggcagagcccgggcgcccgcccagcgcggagacgggcgcgcggggtctctccgcggcgggggcgccgggcctcgggggagcgcagaagtagccgcccgggggtcaggccggagcgccgccggggcttctccctccctccctcgccggttgcctttttttccacttctctccctcccccttccgtttctatttgtgaagggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgcagcccgctgcgcgcgcggcgtgaggaccgcggctccctcctccggggggcgggcacgcggaaggcgctgctgactgagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgatcctcgctcnntctacctcg

SEQ ID NO: 408286 - DNA, 3625 bp, Homo sapiens
cgagcctcctgttcattagcagttgagaaaaattcctttctagtttgatcaatccttgttttcctcggcagagcccgggcgcccgcccagcgcggagacgggcgcgcggggtctctccgcggcgggggcgccgggcctcgggggagcgcagaagtagccgcccgggggtcaggccggagcgccgccggggcttctccctccctccctcgccggttgcctttttttccacttctctccctcccccttccgtttctatttgtgaagggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgcagcccgctgcgcgcgcggcgtgaggaccgcggctccctcctccggggggcgggcacgcggaaggcgctgctgactgagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtccca

SEQ ID NO: 408287 - DNA, 3650 bp, Homo sapiens
cgagcctcctgttcattagcagttgagaaaaattcctttctagtttgatcaatccttgttttcctcggcagagcccgggcgcccgcccagcgcggagacgggcgcgcggggtctctccgcggcgggggcgccgggcctcgggggagcgcagaagtagccgcccgggggtcaggccggagcgccgccggggcttctccctccctccctcgccggttgcctttttttccacttctctccctcccccttccgtttctatttgtgaagggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgcagcccgctgcgcgcgcggcgtgaggaccgcggctccctcctccggggggcgggcacgcggaaggcgctgctgactgagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccggaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacagcagatgccccgtccactgcccccaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtccca

SEQ ID NO: 408288 - DNA, 2125 bp, Homo sapiens
cctgcgagttgaagttgagtgtgccttcctgacagttggcagcactactgtgctgctgtgtgagtgcccgctcagaagatgctcatgaagcagcaggaccggctggaggagcgagagcaggacattgaggaccagctgtacaaactcgagtcagacaagcgcctggtggaggagaaagtgaaccaactgaaggaggaagttcggctgcagtacgagaagctgcaccagctgctggacgaggacctgcggcagacagtggaggtcctagacaaggcccaggccaagttctgcagcgagaacgcagcgcaggcgctgcacctcggggagcgcatgcaggaggccaagaagctgctgggctccctgcagctgctctttgataagacggaggatgtcagcttcatgaagaacaccaagtctgtgaaaatcctgatggacaggacccagacctgcacgagcagcagcctttcccccactaagatcggccacctgaactccaagctcttcctgaacgaagtggccaagaaggagaagcagctgcggaaaatgctagaaggccccttcagcacgccggtgcccttcctgcagagtgtccccctgtacccttgcggcgtgagcagctctggggcggaaaagcgcaagcactcaacggccttcccagaggccagtttcctagagacgtcgtcgggccctgtgggcggccagtacggggcggcgggcacagccagcggtgagggccagtctgggcagcccctggggccctgcagctccacgcagcacttggtggccctgccgggcggcgcccaaccagtgcactcaagccccgtgttccccccatcgcagtatcccaatggctccgccgcccagcagcccatgctcccccagtatggcggccgcaagattctcgtctgttctgtggacaactgttactgttcttccgtggccaaccatggcggccaccagccctacccccgctccggccactttccctggacagtgccctcgcaggagtactcacacccgctcccgcccacaccctccgtcccccagtcccttcccagcctggcggtcagagactggcttgacgcctcccagcagcccggccaccaggatttctacagggtgtatgggcagccgtccaccaaacactacgtgacgagctaacgccacgcaggcggcggggcgctggggaatcttcctccccagcccccgggctcgggagttatgcatccagagacctgcccttctaccttcctcgcctcccctcttcctcattccattgccccaggtcttttccttttggattttgttttggttttggctttgtttttgatttttttttattatgaatctcctggacgcagaggtgacagtgggagctggcctgggccaggacggcaggtggccctggagatgggaaagtgtctgtgtcgaggcgctgagctctctctctgtttctccttttttcctctactccttccccttcacacccccgtggctggaaggaacctcggcttccctgaaagcttgggggtcccacccttcttaccccacccgggaggaacgcccagggccccgggcttgtttctcctcttgttttccttttgggcagtttgatcactgatcgagtaaggaatgacctttagattgtgcgacttttgtttttgtttttttaaatttttttaaaccaagaatgatttctcctgcttccttctcctcaccatcttcccagacggagttcaaaggccacttctcaagcagcttttggcaccttcagcctcagagtggaatcttttaaagacaggacccctatgtccaggaaaggggaaaaggaactttgccaatgatagtgaccacagcaaaagcaaataataataatattaataataataaagagaaataaaataataaaataaaaaacaatagcacagcccttgttgaggtcagcagggaggaggggctgcccggagttgggtccttgcctggattttgacacagcaacttcctgtagtgagcactttgtatgaatcgtggacttcctgttctcaaggcgcaggtatttattctgtatctgtctagagcacacaccaaaatccaaccttctaataaacatgatggcgcagtccca

SEQ ID NO: 408289 - DNA, 1723 bp, Homo sapiens
  misc_feature (290)..(290): n is a, c, g, or t
  misc_feature (325)..(325): n is a, c, g, or t
gtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggtgagtatggggccaggccccagagtcccttatccctatgcccctcatttcccctgctgtttgcccctcagtctttatatctcttccttttcctcctcatcttttctcccttccngcttttttcctcttccttcaaagtctttttccttntctccttcctatgctagcctcctagctccctcttgtgtccctccctttgcctttgagtcagttccatcctggtctcttggtgcctttccttctgaccttgcactgctcctccagccccagctgccctggcttccccaggactgttcctgctccggctcttcaggctccctgctttgtccttttccactgtccgcactgcatctgactcctgcagagaccttgttctcccacccgaccttcctctctgtcctcccctcccacctgcccctcaattcccaggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatgatgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaaggcagtgtagactttaagtcgagcggttttttatttagtagtagtaggc

SEQ ID NO: 408290 - DNA, 1224 bp, Homo sapiens
gtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggcggagctctccccctcaactgagaactcaagtcagctggacttcgaagatgtatggaattcttcctatggtgtgaatgattccttcccagatggagactatgatgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtgaaaaaaaaagt

SEQ ID NO: 408291 - DNA, 486 bp, Homo sapiens
ttcccgggtcgattaatactgcttatactactactaatttcgcggccgcgtagacgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaaggcagtgtagactttaagtcgagcggttttttatttagtagtagtaggc

SEQ ID NO: 408292 - DNA, 1703 bp, Homo sapiens
  misc_feature (290)..(290): n is a, c, g, or t
  misc_feature (325)..(325): n is a, c, g, or t
gtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggtgagtatggggccaggccccagagtcccttatccctatgcccctcatttcccctgctgtttgcccctcagtctttatatctcttccttttcctcctcatcttttctcccttccngcttttttcctcttccttcaaagtctttttccttntctccttcctatgctagcctcctagctccctcttgtgtccctccctttgcctttgagtcagttccatcctggtctcttggtgcctttccttctgaccttgcactgctcctccagccccagctgccctggcttccccaggactgttcctgctccggctcttcaggctccctgctttgtccttttccactgtccgcactgcatctgactcctgcagagaccttgttctcccacccgaccttcctctctgtcctcccctcccacctgcccctcaattcccaggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatgatgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtgaaaaaaaaagt

SEQ ID NO: 408293 - DNA, 688 bp, Homo sapiens
tgcctgtttttctttaaaaaaaaaaaattgggagtaattttaaagacaaagtttatgtgaagatacatttttaaggtgctattttgtgtatagcccattttcatgttttcttcctttttgtgagaatatagcctctcctaattcatagcaagaatttgatatgatgttccatagttttaagaaagtcattatatttctgtttctgcttattaaacgtgtgtgtagcaaaatgatgatgattacaccaaagtgttataaattcattgcataaggtgttttctgatttattatttctcatggtggccctgtgcccctctctactgatttgttattatgttaacttcaagcattagttcttggtcatgggaagttgaagatgattgtgggtaggaaagagtgaactggccgggcgctgtggctcacgcctgtaatcctagctctttgagaggctgaagcgggcagattgcctgaggtcaggagtgtgagaccagcctgggcaacatggtaaaaccctctttactaaagtacaaaaaattagccaggtgtggtggcccactcctgcagtcctaactgcataggaggctaaggcaccagaatcttttgaacctgggaggcggaggttgcattgagccacgattgtgccatttgcattctagcctgggcaacagggcaagactctgtctcaaaa

SEQ ID NO: 408294 - DNA, 782 bp, Homo sapiens
gtaacagccttatggcttccatgctataatcaaagggatgtatttgattcagttaagatagaatctgtgtttctatttcttttatttcatcttattagaaaagtaatgctctgtatagaaactagaagaaaattaaaatcatctagtccccacctaccagacaaccagctttgatgtacatcatttgatgtatgtttttgtttttttaacataaaaggattatatccttttccgccagctgttttcactcaatacattgtgaaaatattttcacatatgttgcatgggtttctataacatttgaaatgactgccaaatatttcactgtatgatcatcatttaatattattatcaattttgtatatttaagttagaacttttccattaccataaacatcattatgaatgagctttcttgaactgtattttaatatacttccttaggataaatgcttaaagtaataattattgaattgctttccaaaaacattgcactccatcccaattgttttggaataccctttaccatatatccttgatcatactgcctgtttttctttaaaaaaaaaaaattgggagtaattttaaagacaaagtttatgtgaagatacatttttaaggtgctattttgtgtatagcccattttcatgttttcttcctttttgtgagaatatagcctctcctaattcatagcaagaatttgatatgatgttccatagttttaagaaagtcattatatttctgtttctgcttattaaacgtgtgtgtagcaaaatgatgat

SEQ ID NO: 408295 - DNA, 857 bp, Homo sapiens
  misc_feature (34)..(34): n is a, c, g, or t
  misc_feature (47)..(47): n is a, c, g, or t
  misc_feature (49)..(49): n is a, c, g, or t
  misc_feature (56)..(56): n is a, c, g, or t
  misc_feature (60)..(60): n is a, c, g, or t
cgccgggacgggtgctcggggggggggggggggncgcgacgccccancnccccctnctcngttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgcaattt

SEQ ID NO: 408296 - DNA, 502 bp, Homo sapiens
acctcctacttcccggccttccatcccagtttcttctaggaattcggagcctcccctgcagcgactcggaagattcgaggcggcgggggacaagtcggcgccccagagcggacgaggtgaggagaggagaggtccccgcggagagctgagcagacgcgcgggtgggctcagcctgtgagatgcggtggagatagcgggccgggctcgggctgtcgctgggaggggcccgcgagcctggccttcgggtcccggcgccgcgaggcgaccccggccgggccgagagagggagaaggcggcgagcattcgggcctccctgcgaggaatggagggagagcggaaacgcagagagtttcactgcgaggaagggagggagagcggtcagcgcagctccagcatttctaagtagaaaggcgagggattgcaattcggatttcttttctttcttttttggcggacagtggtggtgctgtggctggggaataaagaactgatgaagctgagg

SEQ ID NO: 408297 - DNA, 5825 bp, Homo sapiens
cctcagatttctcaggagaccagaactgatctgccagccttgctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtggcgcgatctcggctcactgcaagctccgcctcctgggttcacgccattctcctgcctcagcctcccaagtagctgggactacaggcacccgccaccacgcccggctaaattttttgtatttttcagtagagacggggtttcaccatgttagccaggatgtccacttttttcttaaatgaacatattgtcttataaccagcaaatgaagttttacttttttaatcagaaaaaatttcgtcataaagctatatttttatatttttaaaattgatacagttagataccttcagattacctaagttaagtttttgccaaaatgctattttatgccctttttgtaaagttatgatttattttgtaaatatagttccttatagttttctcttgagtgtttggacatgagaatagataagattaaattacaatttacaagatcacttcattaggcacaggaaaagtatttaacaaaattcaacaccctttcacaataaaaaataaaaaataaaaaaccctcaacaaactaggaatagaaggaaacttcctcaacctgataaagggcatctatgaagaacccatggttagcatcatacttaatggtgaaggactggattatttccccctgagatcagaaacaagacaaggatgtctgctttggccatttctattcaacttgtactggacagtcaagaaagggcaattaggcaagaaaataaaataaaagtcatctaggttggaaaggaagaagtataactaaatagagatgggagacgatatggtggttttgtgcatagtaatccaagggaaaactatagaaaatccaaaggcatgatttattaataaataaattcagcaaagttacaggatacaggattaaatatgcagaaattggttatctttcaatatagtatcaatgaataaatcaaaaatgatgttaagaaaacaatttaattttcaacaatggtcaagcttggtggcttgtgcctgtaatcccaacactttgggagtctgaggcagaaagactgctagaggccaggagaccagcctgggaaacagtgagatcccatctctacaaaaacaaacaaacaaaaaacaacaagcaaacaaaaaacagctggatgtgatgacactcatctgtcgtctcagctactcagaggctgaggtgtaaggatggcttgagccccaaagttcgaagctgcaatgagctataactgggtcactgcaatccagcctggatgacagagttagaccttgactcaaaaaaaacaaaaaagaaaagaaaaaaattgacagcatcagaaagagtaaaataccaatataattgagggtccagaaatattgatcacatttatcatcaactgacttttgaaaatagtgctaagacaattcaatgggggcaaaatagtctttttcattaaatgatgcttggaaacatggatatccacatgcaaaataatgaaattggactcctacctcatattgcatataaaaattaactcaaagttgacctaagatctaaatgtaagagctaatattgtaagtatcttcaaagaaaacatggcgtaaatctttctgactttgaattaggcaatgatttcttaaataaatgacactaaaaacacaagcaacaaaagaagaaaataggtaaattaaaattaaaaccatttgtgtttccaaggacaatatcaagaaagcaaaaatacaacccacagaatgagataattttttttaaaatcatgtattagttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgcaattt

SEQ ID NO: 408298 - DNA, 5860 bp, Homo sapiens
acctcctacttcccggccttccatcccagtttcttctaggaattcggagcctcccctgcagcgactcggaagattcgaggcggcgggggacaagtcggcgccccagagcggacgagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtggcgcgatctcggctcactgcaagctccgcctcctgggttcacgccattctcctgcctcagcctcccaagtagctgggactacaggcacccgccaccacgcccggctaaattttttgtatttttcagtagagacggggtttcaccatgttagccaggatgtccacttttttcttaaatgaacatattgtcttataaccagcaaatgaagttttacttttttaatcagaaaaaatttcgtcataaagctatatttttatatttttaaaattgatacagttagataccttcagattacctaagttaagtttttgccaaaatgctattttatgccctttttgtaaagttatgatttattttgtaaatatagttccttatagttttctcttgagtgtttggacatgagaatagataagattaaattacaatttacaagatcacttcattaggcacaggaaaagtatttaacaaaattcaacaccctttcacaataaaaaataaaaaataaaaaaccctcaacaaactaggaatagaaggaaacttcctcaacctgataaagggcatctatgaagaacccatggttagcatcatacttaatggtgaaggactggattatttccccctgagatcagaaacaagacaaggatgtctgctttggccatttctattcaacttgtactggacagtcaagaaagggcaattaggcaagaaaataaaataaaagtcatctaggttggaaaggaagaagtataactaaatagagatgggagacgatatggtggttttgtgcatagtaatccaagggaaaactatagaaaatccaaaggcatgatttattaataaataaattcagcaaagttacaggatacaggattaaatatgcagaaattggttatctttcaatatagtatcaatgaataaatcaaaaatgatgttaagaaaacaatttaattttcaacaatggtcaagcttggtggcttgtgcctgtaatcccaacactttgggagtctgaggcagaaagactgctagaggccaggagaccagcctgggaaacagtgagatcccatctctacaaaaacaaacaaacaaaaaacaacaagcaaacaaaaaacagctggatgtgatgacactcatctgtcgtctcagctactcagaggctgaggtgtaaggatggcttgagccccaaagttcgaagctgcaatgagctataactgggtcactgcaatccagcctggatgacagagttagaccttgactcaaaaaaaacaaaaaagaaaagaaaaaaattgacagcatcagaaagagtaaaataccaatataattgagggtccagaaatattgatcacatttatcatcaactgacttttgaaaatagtgctaagacaattcaatgggggcaaaatagtctttttcattaaatgatgcttggaaacatggatatccacatgcaaaataatgaaattggactcctacctcatattgcatataaaaattaactcaaagttgacctaagatctaaatgtaagagctaatattgtaagtatcttcaaagaaaacatggcgtaaatctttctgactttgaattaggcaatgatttcttaaataaatgacactaaaaacacaagcaacaaaagaagaaaataggtaaattaaaattaaaaccatttgtgtttccaaggacaatatcaagaaagcaaaaatacaacccacagaatgagataattttttttaaaatcatgtattagttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgcaattt

SEQ ID NO: 408299 - DNA, 6786 bp, Homo sapiens
acctcctacttcccggccttccatcccagtttcttctaggaattcggagcctcccctgcagcgactcggaagattcgaggcggcgggggacaagtcggcgccccagagcggacgagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaatcttgttggagacttcagaatttcatcctctcatctaagtattgatgttattttcagactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgattctcgccctgttgcccaggctggagtgcagtgatgcaattgcggctcactgcaacctccacctcccaggttcaagcgattcttcctgcctcagcctcccgagtagccaggaccacagatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggattggaatgctgaataatggattggaatgttgaataatgttgaataccttcctatggtatcctccctaactccttccccttgaaccacccagccccatctatggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggtaggcacccaccactcaacttagagcaaaatatactggatcaatgattgctaatttctactcaaaaaaagttaaatattttacatttgtctttgattaattcgttgctctaatgtgggtagagagattaccatgtgccatgttcatgtgggcataaagagtagataaagagaggagctcaatggcaattagaatttgagaaatgcttatctcgaaacactttaccactcagttcccaagcatagtggggtatttttgctttcctgtaggagatttggagtagtcatagaatattacatgaaaacattctttcatatgaccgctgtggcatcctgctggtatacctaatgttggagaactaacctataaattaatctcataaagatctttgtaagaacatgggattacaatccatcatctctgccctgctccagggagcagtgcctgggtgagtctggagaagattctgaaggttaaaacattgctattgttattgttattttacattttaggagaatcctacaacttgagttaccaccttgtaattctgccctttcaagattaaattcaaggagctcccttttgcttcccaaatgagaacatgtataggacttgaactaatgcagccatctcctgtgcttttcaggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtggcgcgatctcggctcactgcaagctccgcctcctgggttcacgccattctcctgcctcagcctcccaagtagctgggactacaggcacccgccaccacgcccggctaaattttttgtatttttcagtagagacggggtttcaccatgttagccaggatgtccacttttttcttaaatgaacatattgtcttataaccagcaaatgaagttttacttttttaatcagaaaaaatttcgtcataaagctatatttttatatttttaaaattgatacagttagataccttcagattacctaagttaagtttttgccaaaatgctattttatgccctttttgtaaagttatgatttattttgtaaatatagttccttatagttttctcttgagtgtttggacatgagaatagataagattaaattacaatttacaagatcacttcattaggcacaggaaaagtatttaacaaaattcaacaccctttcacaataaaaaataaaaaataaaaaaccctcaacaaactaggaatagaaggaaacttcctcaacctgataaagggcatctatgaagaacccatggttagcatcatacttaatggtgaaggactggattatttccccctgagatcagaaacaagacaaggatgtctgctttggccatttctattcaacttgtactggacagtcaagaaagggcaattaggcaagaaaataaaataaaagtcatctaggttggaaaggaagaagtataactaaatagagatgggagacgatatggtggttttgtgcatagtaatccaagggaaaactatagaaaatccaaaggcatgatttattaataaataaattcagcaaagttacaggatacaggattaaatatgcagaaattggttatctttcaatatagtatcaatgaataaatcaaaaatgatgttaagaaaacaatttaattttcaacaatggtcaagcttggtggcttgtgcctgtaatcccaacactttgggagtctgaggcagaaagactgctagaggccaggagaccagcctgggaaacagtgagatcccatctctacaaaaacaaacaaacaaaaaacaacaagcaaacaaaaaacagctggatgtgatgacactcatctgtcgtctcagctactcagaggctgaggtgtaaggatggcttgagccccaaagttcgaagctgcaatgagctataactgggtcactgcaatccagcctggatgacagagttagaccttgactcaaaaaaaacaaaaaagaaaagaaaaaaattgacagcatcagaaagagtaaaataccaatataattgagggtccagaaatattgatcacatttatcatcaactgacttttgaaaatagtgctaagacaattcaatgggggcaaaatagtctttttcattaaatgatgcttggaaacatggatatccacatgcaaaataatgaaattggactcctacctcatattgcatataaaaattaactcaaagttgacctaagatctaaatgtaagagctaatattgtaagtatcttcaaagaaaacatggcgtaaatctttctgactttgaattaggcaatgatttcttaaataaatgacactaaaaacacaagcaacaaaagaagaaaataggtaaattaaaattaaaaccatttgtgtttccaaggacaatatcaagaaagcaaaaatacaacccacagaatgagataattttttttaaaatcatgtattagttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgcaattt

SEQ ID NO: 408300 - DNA, 3356 bp, Homo sapiens
actttgttctctgattgtcctggcagaaattaatgcagttaagtgtacaagttctgacaatatccctaggtccggctgtgctttcaatctaaaatcaactccttttccttacaaagtgttgaataagtaataatttactaagggacgtttttaagcagctacttaaaaaatgcctaggcctccaagaattcattgactctgagtttgcttctttgtggagactcttgatggggaaattaacctctgacacaacctttgaaatggtaattacacatttattttcttccaggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtggcgcgatctcggctcactgcaagctccgcctcctgggttcacgccattctcctgcctcagcctcccaagtagctgggactacaggcacccgccaccacgcccggctaaattttttgtatttttcagtagagacggggtttcaccatgttagccaggatgtccacttttttcttaaatgaacatattgtcttataaccagcaaatgaagttttacttttttaatcagaaaaaatttcgtcataaagctatatttttatatttttaaaattgatacagttagataccttcagattacctaagttaagtttttgccaaaatgctattttatgccctttttgtaaagttatgatttattttgtaaatatagttccttatagttttctcttgagtgtttggacatgagaatagataagattaaattacaatttacaagatcacttcattaggcacaggaaaagtatttaacaaaattcaacaccctttcacaataaaaaataaaaaataaaaaaccctcaacaaactaggaatagaaggaaacttcctcaacctgataaagggcatctatgaagaacccatggttagcatcatacttaatggtgaaggactggattatttccccctgagatcagaaacaagacaaggatgtctgctttggccatttctattcaacttgtactggacagtcaagaaagggcaattaggcaagaaaataaaataaaagtcatctaggttggaaaggaagaagtataactaaatagagatgggagacgatatggtggttttgtgcatagtaatccaagggaaaactatagaaaatccaaaggcatgatttattaataaataaattcagcaaagttacaggatacaggattaaatatgcagaaattggttatctttcaatatagtatcaatgaataaatcaaaaatgatgttaagaaaacaatttaattttcaacaatggtcaagcttggtggcttgtgcctgtaatcccaacactttgggagtctgaggcagaaagactgctagaggccaggagaccagcctgggaaacagtgagatcccatctctacaaaaacaaacaaacaaaaaacaacaagcaaacaaaaaacagctggatgtgatgacactcatctgtcgtctcagctactcagaggctgaggtgtaaggatggcttgagccccaaagttcgaagctgcaatgagctataactgggtcactgcaatccagcctggatgacagagttagaccttgactcaaaaaaaacaaaaaagaaaagaaaaaaattgacagcatcagaaagagtaaaataccaatataattgagggtccagaaatattgatcacatttatcatcaactgacttttgaaaatagtgctaagacaattcaatgggggcaaaatagtctttttcattaaatgatgcttggaaacatggatatccacatgcaaaataatgaaattggactcctacctcatattgcatataaaaattaactcaaagttgacctaagatctaaatgtaagagctaatattgtaagtatcttcaaagaaaacatggcgtaaatctttctgactttgaattaggcaatgatttcttaaataaatgacactaaaaacacaagcaacaaaagaagaaaataggtaaattaaaattaaaaccatttgtgtttccaaggacaatatcaagaaagcaaaaatacaacccacagaatgagataattttttttaaaatcatgtattagttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgcaattt

SEQ ID NO: 408301 - DNA, 1822 bp, Homo sapiens
gcggccgcctactactactactgctcgaattcaagcttctaacgatgtacggggcatgatttattaataaataaattcagcaaagttacaggatacaggattaaatatgcagaaattggttatctttcaatatagtatcaatgaataaatcaaaaatgatgttaagaaaacaatttaattttcaacaatggtcaagcttggtggcttgtgcctgtaatcccaacactttgggagtctgaggcagaaagactgctagaggccaggagaccagcctgggaaacagtgagatcccatctctacaaaaacaaacaaacaaaaaacaacaagcaaacaaaaaacagctggatgtgatgacactcatctgtcgtctcagctactcagaggctgaggtgtaaggatggcttgagccccaaagttcgaagctgcaatgagctataactgggtcactgcaatccagcctggatgacagagttagaccttgactcaaaaaaaacaaaaaagaaaagaaaaaaattgacagcatcagaaagagtaaaataccaatataattgagggtccagaaatattgatcacatttatcatcaactgacttttgaaaatagtgctaagacaattcaatgggggcaaaatagtctttttcattaaatgatgcttggaaacatggatatccacatgcaaaataatgaaattggactcctacctcatattgcatataaaaattaactcaaagttgacctaagatctaaatgtaagagctaatattgtaagtatcttcaaagaaaacatggcgtaaatctttctgactttgaattaggcaatgatttcttaaataaatgacactaaaaacacaagcaacaaaagaagaaaataggtaaattaaaattaaaaccatttgtgtttccaaggacaatatcaagaaagcaaaaatacaacccacagaatgagataattttttttaaaatcatgtattagttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgcaattt

SEQ ID NO: 408302 - DNA, 911 bp, Homo sapiens
  misc_feature (34)..(34): n is a, c, g, or t
  misc_feature (47)..(47): n is a, c, g, or t
  misc_feature (49)..(49): n is a, c, g, or t
  misc_feature (56)..(56): n is a, c, g, or t
  misc_feature (60)..(60): n is a, c, g, or t
cgccgggacgggtgctcggggggggggggggggncgcgacgccccancnccccctnctcngttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgcaattt

SEQ ID NO: 408303 - DNA, 692 bp, Homo sapiens
ttaatatgatacatttaactggttggaaaggataagcttttttgtgttcacagcaagcaaagatgattataatccaattttagttttaaaattgggacttgtgctgaaacaccatagtcttgtgggcagagttgattgcttgtagaagacttctattagcaatcacttatactcggtgatcctcagaaaactgtttcttaaattatttttttcccttgattaatattttaatatggatacaaacaccaagaggccttctttgcagtgtcatttatctcttacaaatctcattttcctttcagatattatcagacgcgacacagcctcttgaaagtcagaatttttctcctgtggtgagagatgtaagttatgagcagaatattttttcataaatgtatttttttactaccatttttgctctcttctctctgtttctctctctctccatctttgtcattctgtcttttctctatcagtcatgacaccttgtttgtaggactaaaatgtggatactaaagaaatgtcttgtgtcatatacatttaggcagtgattacatccaacggtacattacctgataaatataaatatatccagacactccgggagagcaggtaagtattgttcaaatcctcttgttttatacatttattcttatcttggaattcatgagtattttttaatgcttcaatgg

SEQ ID NO: 408304 - DNA, 5771 bp, Homo sapiens
cctcagatttctcaggagaccagaactgatctgccagccttgctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtggcgcgatctcggctcactgcaagctccgcctcctgggttcacgccattctcctgcctcagcctcccaagtagctgggactacaggcacccgccaccacgcccggctaaattttttgtatttttcagtagagacggggtttcaccatgttagccaggatgtccacttttttcttaaatgaacatattgtcttataaccagcaaatgaagttttacttttttaatcagaaaaaatttcgtcataaagctatatttttatatttttaaaattgatacagttagataccttcagattacctaagttaagtttttgccaaaatgctattttatgccctttttgtaaagttatgatttattttgtaaatatagttccttatagttttctcttgagtgtttggacatgagaatagataagattaaattacaatttacaagatcacttcattaggcacaggaaaagtatttaacaaaattcaacaccctttcacaataaaaaataaaaaataaatctatgaagaacccatggttagcatcatacttaatggtgaaggactggattatttccccctgagatcagaaacaagacaaggatgtctgctttggccatttctattcaacttgtactggacagtcaagaaagggcaattaggcaagaaaataaaataaaagtcatctaggttggaaaggaagaagtataactaaatagagatgggagacgatatggtggttttgtgcatagtaatccaagggaaaactatagaaaatccaaaggcatgatttattaataaataaattcagcaaagttacaggatacaggattaaatatgcagaaattggttatctttcaatatagtatcaatgaataaatcaaaaatgatgttaagaaaacaatttaattttcaacaatggtcaagcttggtggcttgtgcctgtaatcccaacactttgggagtctgaggcagaaagactgctagaggccaggagaccagcctgggaaacagtgagatcccatctctacaaaaacaaacaaacaaaaaacaacaagcaaacaaaaaacagctggatgtgatgacactcatctgtcgtctcagctactcagaggctgaggtgtaaggatggcttgagccccaaagttcgaagctgcaatgagctataactgggtcactgcaatccagcctggatgacagagttagaccttgactcaaaaaaaacaaaaaagaaaagaaaaaaattgacagcatcagaaagagtaaaataccaatataattgagggtccagaaatattgatcacatttatcatcaactgacttttgaaaatagtgctaagacaattcaatgggggcaaaatagtctttttcattaaatgatgcttggaaacatggatatccacatgcaaaataatgaaattggactcctacctcatattgcatataaaaattaactcaaagttgacctaagatctaaatgtaagagctaatattgtaagtatcttcaaagaaaacatggcgtaaatctttctgactttgaattaggcaatgatttcttaaataaatgacactaaaaacacaagcaacaaaagaagaaaataggtaaattaaaattaaaaccatttgtgtttccaaggacaatatcaagaaagcaaaaatacaacccacagaatgagataattttttttaaaatcatgtattagttaagggaggaatttgtatttagaatatgtaaagaactgttacaataataattaaaaggcatataattcaatttttaaaaatcaacaagagatctgaattaacagttctccaaagaagatacacaaaaggccaataagcacatgaaaaggttctcaacatcactagccatcagggaaatgcaaatgagatctacaatgagatatcacttaacactcactggaatagatatataatcaaagtgataatatcaagtgttggtgaggatgcagagaaattggaaccctcatgcactgttggtggatacccacgtgatataaaaacaaatgtctacacaaaaacttgtgcacagatgttctttgcagcattatttataatagcccaaaattgaaacagccctaatttctatcaactaacaagtgaataaacaaaacgtggcatatccatacaaggaatattattcagcaataaaaaaagagatgaagtactgatatgcaccacaacatggaaaaaccttgaaaacatatcaagtgaagaatgccagacatgaaaggccacatattatatgatttcatttatatgaaatgtccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaaaattaaattacaaatgcaattt

SEQ ID NO: 408305 - DNA, 726 bp, Homo sapiens
acctcctacttcccggccttccatcccagtttcttctaggaattcggagcctcccctgcagcgactcggaagattcgaggcggcgggggacaagtcggcgccccagagcggacgagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggtaagtatgccagggcttacatcacccacttcctaaattggcttggggaataactgtgagttttctcttttctgcggcaaggggataggagtgtttatttccatggaaaaaattaaaatgaag

SEQ ID NO: 408306 - DNA, 2078 bp, Homo sapiens
tcttttgaacttaacattttccccctgacattggagactctcctgctacctctctcctaagaaaaaagggcaggtggtggggggacaagccccttccaccttcccatctccaagggactttgcagtgtgggtgatggtgtggctgatcatcctctttctgcacctctgattctgcttgtgttgtccttattgtgtggggcaggagggtcaggacttcagctaggggtgtgctggctctgcagtgactcaggcctgggtgttttttggtgaatttaaaaagatgaccatttctgggggaaagtgacacttttactttctccacaccttcaccatccattttcttactggacttcgctgcgttcctgcaaggaggacagggcagagagtagcaaccctccttgccgaggcccagaaagatagcgtggtgtgcccagggcacccatggtgggtgatggacatctccttttgggtgccaaggcttcctcaaggtgggaggaactggagggcaggggacggtggccagtgtcccgctctagccctctagggcacctttttctcccctctgaagttgttaggctgatctggagtctgctccaggcctgggcttcaccctggcctcatgccctgcccagcacctgtgtggagggacctgttcgtattcattcctctttgggggccaagctcagggcacccgaaccagcagccttgggtggctgaacctagtgggacagaagggaggcagttgtatctggcagagtcacccaaggccacaggcctgagcaaagcaggagagcggggcaagctggggtcagggaccatggtgctggccccctgctgctctggccatgtgggaggcagctggaggggtcccaagtggcagctcctgccagactaccccggactcccgagcccatcgtcctgtactcttctccagtgggacgtctggccctcactgtggctagcttctgggcaagtccctctgctcaagatcactttatggggcagctggtgccccctggggctcccacactctgcacatacaatttagggacctggcagggtcttggtggcctgcagcttccctttctggaaccgactcgcctcccatcagagagccataactcttcttcaatacagtattgtttgaactttgaaatatatgcatttgtctatgtattttcttaaaaattaacactgtatctcaataagcatacaatggattgttcaatggtacagtttggaaccaatcccccgccacttccctccccaagtaaagccaggacagatgctggagtcagcatgggagctgtggaaaccttttgccctggagccaggtgcctgtggctgtgcctgggagtggcttcagcccaggcgtggtgtcagtttcctggcacccctgcccaggagcctgcatgaaggcagccgggtctctctctgagtggctggtgcaccggctcatttctgagtggcctcctgcgtatgaagaaaaagcggccacgtggcatgcctcccttccctcccttgctttcctctcaaagagccaagtcacgctgcactgcgctccgtggagcctttcccgatggagaagagaagggaggcctgagatgtcctttgctgggatgtggagaaacaccatctatatgaaaagccccttgcttgctctgctgattttctccctcccctggccctggagagaaaggctgtgccattcaaagacagtttggggacatgggggctgcaggcctgatcttatttttatgcaaattttgttctgggagcagtggtttatacaaactcctgtagcataattccagcttgtgtgtggctgtccttgagtagtgattctgaagtgatgactgtgatgctatgcctaaaaacatcatcagggtactttgtatctgtcactgtgtttgaacggccctcaatttctatctaataaaaccagtcaaatggttcacctagcaaagactctgtggctgtggctgtgtgtgtgtgttagtgtgtgtgtgtgtgcgcatatgtgtttttgtgtgtgtttatggggattgtgccacactgggctgacagcagcacagccc

SEQ ID NO: 408307 - DNA, 2035 bp, Homo sapiens
tcttttgaacttaacattttccccctgacattggagactctcctgctacctctctcctaagaaaaaagggcaggtggtggggggacaagccccttccaccttcccatctccaagggactttgcagtgtgggtgatggtgtggctgatcatcctctttctgcacctctgattctgcttgtgttgtccttattgtgtggggcaggagggtcaggacttcagctaggggtgtgctggctctgcagtgactcaggcctgggtgttttttggtgaatttaaaaagatgaccatttctgggggaaagtgacacttttactttctccacaccttcaccatccattttcttactggacttcgctgcgttcctgcaaggaggacagggcagagagtagcaaccctccttgccgaggcccagaaagatagcgtggtgtgcccagggcacccatggtgggtgatggacatctccttttgggtgccaaggcttcctcaaggtgggaggaactggagggcaggggacggtggccagtgtcccgctctagccctctagggcacctttttctcccctctgaagttgttaggctgatctggagtctgctccaggcctgggcttcaccctggcctcatgccctgcccagcacctgtgtggagggacctgttcgtattcattcctctttgggggccaagctcagggcacccgaaccagcagccttgggtggctgaacctagtgggacagaagggaggcagttgtatctggcagagtcacccaaggccacaggcctgagcaaagcaggagagcggggcaagctggggtcagggaccatggtgctggccccctgctgctctggccatgtgggaggcagctggaggggtcccaagtggcagctcctgccagactaccccggactcccgagcccatcgtcctgtactcttctccagtgggacgtctggccctcactgtggctagcttctgggcaagtccctctgctcaagatcactttatggggcagctggtgccccctggggctcccacactctgcacatacaatttagggacctggcagggtcttggtggcctgcagcttccctttctggaaccgactcgcctcccatcagagagccataactcttcttcaatacagtattgtttgaactttgaaatatatgcatttgtctatgtattttcttaaaaattaacactgtatctcaataagcatacaatggattgttcaatggtacagtttggaaccaatcccccgccacttccctccccaagtaaagccaggacagatgctggagtcagcatgggagctgtggaaaccttttgccctggagccaggtgcctgtggctgtgcctgggagtggcttcagcccaggcgtggtgtcagtttcctggcacccctgcccaggagcctgcatgaaggcagccgggtctctctctgagtggctggtgcaccggctcatttctgagtggcctcctgcgtatgaagaaaaagcggccacgtggcatgcctcccttccctcccttgctttcctctcaaagagccaagtcacgctgcactgcgctccgtggagcctttcccgatggagaagagaagggaggcctgagatgtcctttgctgggatgtggagaaacaccatctatatgaaaagccccttgcttgctctgctgattttctccctcccctggccctggagagaaaggctgtgccattcaaagacagtttggggacatgggggctgcaggcctgatcttatttttatgcaaattttgttctgggagcagtggtttatacaaactcctgtagcataattccagcttgtgtgtggctgtccttgagtagtgattctgaagtgtatctgtcactgtgtttgaacggccctcaatttctatctaataaaaccagtcaaatggttcacctagcaaagactctgtggctgtggctgtgtgtgtgtgttagtgtgtgtgtgtgtgcgcatatgtgtttttgtgtgtgtttatggggattgtgccacactgggctgacagcagcacagccc

SEQ ID NO: 408308 - DNA, 763 bp, Homo sapiens
attctcctgcctcagcctcccaagtagctgggattacaggcgcccaccactttgcccagctaatttttggtatttttagtagagacggggccaccattttggccaggctggttgtgaactcctgacctcgtgattcgcccacctcctcctcccaaagtgctgggattataggtgtgggccaccgtgcccggccaaactcactcttttgaacttaacattttccccctgacattggagactctcctgctacctctctcctaagaaaaaagggcaggtggtggggggacaagccccttccaccttcccatctccaagggactttgcagtgtgggtgatggtgtggctgatcatcctctttctgcacctctgattctgcttgtgttgtccttattgtgtggggcaggagggtcaggacttcagctaggggtgtgctggctctgcagtgactcaggcctgggtgttttttggtgaatttaaaaagatgaccatttctgggggaaagtgacacttttactttctccacaccttcaccatccattttcttactggacttcgctgcgttcctgcaaggaggacagggcagagagtagcaaccctccttgccgaggcccagaaagatagcgtggtgtgcccagggcacccatggtgggtgatggacatctccttttgggtgccaaggcttcctcaaggtgggaggaactggagggcaggggacggtggccagtgtcccgctctagccctctagggcacctttttctcccct

SEQ ID NO: 408309 - DNA, 1009 bp, Homo sapiens
gatctagcagatcctctcgacggtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtactgaaggaatcttacaagaaatggtgttccgattggtcacggtcccaaaacacttggagctgaggccgagtacgaaccatccgggaagaaaggtggttggaagatccagcgttcttgagagctaccggtgttgcaaggggttcggagggaccgtttaagggaagacattcctccgaataacggacgtatctgggggaaacattaccgtccacatccg

SEQ ID NO: 408310 - DNA, 1470 bp, Homo sapiens
gatctagcagatcctctcgacggtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtgaaatggcagtgttcatcattgg

SEQ ID NO: 408311 - DNA, 1318 bp, Homo sapiens
gcgcagtcccggctcctggcggcgtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaag

SEQ ID NO: 408312 - DNA, 1400 bp, Homo sapiens
cacacacacacggtctttgatttagtggtttagactagctgtgttttcagaagttacttctttgtcaaagacgatagcctttatactctttaatttgattttatgcccttttaagctaccttatttagaaggagcagagtgtataaaagctgttcctggcaaagggccacagcagcctaataaacaaatctgacaggagcccagtttgttactaagccaagaataaggcttctctctgttctgaccagtgagattcctgaaacttaactattttttcttgatttttgatattaattatatttgattgtcatattactgtgtttagtgtgtcaaaatacagtcttgaaaatgataagtattatctctgaatccttttttttttccattcaagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtgaaatggcagtgttcatcattgg

SEQ ID NO: 408313 - DNA, 1240 bp, Homo sapiens
ttattcgtaggaaaagagaaaggagcagctggtactgtctctctcctccctcttattgaatgaccttcaaagtcccacaacttaaaccaacattgttagtaccatggttccgttacattataaaataaatacaagattcatataagatgtaaaatggtctcattcttttagtttggaatttttatctaatttctgattttttaatttaaaagcgaactttgatagcatgattgaattgaatttcaaagctccatatttctgcaggagaggctcctacttaccgtctgaactttttgcctccgaccttatcttgattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtgaaatggcagtgttcatcattgg

SEQ ID NO: 408314 - DNA, 1496 bp, Homo sapiens
gcgcagtcccggctcctggcggcgtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtgaaatggcagtgttcatcattgg

SEQ ID NO: 408315 - DNA, 1092 bp, Homo sapiens
gcgcagtcccggctcctggcggcgtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtgatcacgtttcgtgttcatactcaacgttaataaaaggagagagtttgtagtgaaatggcagtgttcatcattgg

SEQ ID NO: 408316 - DNA, 650 bp, Homo sapiens
gcgcagtcccggctcctggcggcgtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagggggatccagaatgactgctggagttactactgtcatatctacctctcaggcatcaaaagggaagcaagacggggaagagtctttcttggtcacccaggctagggtacagtggcacgatcttggctcacagcaacctcttcctcccgggctcaagcagttgtc

SEQ ID NO: 408317 - DNA, 440 bp, Homo sapiens
  misc_feature (15)..(15): n is a, c, g, or t
  misc_feature (55)..(55): n is a, c, g, or t
gattccgaatttaantcggactcacctatagggaatttggcccctcgaggcccanaattcggcacagaactggagatacaatgaggagtgaaatatatagtccctctctgaaagcttgtgcatcatacaaaacagtgcagataatggtaaatgcttttgcacaaaaccccataagacttagaggcaagcagaaatgacgcaagtatgaaactcaagctggctgcccgctgtgctttgagtaatgaagtcccttgtctctgatccaggaagctcctgtcttctgccagcatctgtcagcaggctaatttgtcagcttgcaaatagggagacatctcaggcttgtcacagttctttacagttactagcctcatgtggctatttccaattaaaattaaattttaagtttaaaatgcagttcctcagatgcactcattaattaa

SEQ ID NO: 408318 - DNA, 389 bp, Homo sapiens
  misc_feature (222)..(222): n is a, c, g, or t
  misc_feature (383)..(383): n is a, c, g, or t
tcagtggccaagtttccagtgaccatccgccatcctgtcatacccaagctatacgaccctggaccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaancacgtggagtattacactatgcctttgggaagggttggtttgctggtaggaacctggccatatctcaggtcaccaccaaatacgttctctgggtggacgatgattttctcttcaacgaggagaccaagattgaggtgctggtggatgtcctggagaaaacngaactg

SEQ ID NO: 408319 - DNA, 216 bp, Homo sapiens
aacaaaaccaactatagctatgactcagtttataacacgtttacccttaataagtttacctaattagaaatgtatatgttaataaaaatttttacactttaaagaggatttttaaagaatgaaatcctgactcatttgttgtctcaagtgactacagataccccttgaattaagatggggttatgtcctgagaaactcatcctaagttgaaaatac

SEQ ID NO: 408320 - DNA, 348 bp, Homo sapiens
ctctacaactgtaaataattagaaaaggtttttttttaatttttactttagaaatttttgttaaagaactctctctctcttaatgtccaaagtcttagacagttggacatcttttccttctggaaagatgtgaaactttgtagaatggagaagaaatgtaaagagtacttaacactaaaagaaaaggcggtgaaaagccaaaccctgttgtgttagtctgttcttatgttgttttaaagaaatagctgaggctgggtaatttatacagaaaagaggtttaattggctcatggttctgcaggctgtacaagaggcatggtatcagcatctgctcggcttctgggaaggc

SEQ ID NO: 408321 - DNA, 705 bp, Homo sapiens
acccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtgccccccatgtacctctgggtccttggtcccatctacctcctcttcatccaccaccatggccggggctacctccagatgtccccactcttcaaagccaagatggtagctgccatccctgggagcctggaaccaggcaatggtggggggaggcaggggacaggctggaacctggtgaagtcttaaagtagactcctcctatcggggtgtagaagggaatctgttaatcaaacagagcaatattagaaaggctacagaggtcaactcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagggccacattaggatgaaccttttaaaaagttatgcatttatttttatgtttccccactagctgtattataggacaatttttatatgtgatatgtatttaccttagtgtgttaaataaacactggcattccaagtgtgag

SEQ ID NO: 408322 - DNA, 678 bp, Homo sapiens
acccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtgccccccatgtacctctgggtccttggtcccatctacctcctcttcatccaccaccatggccggggctacctccagatgtccccactcttcaaagccaagatggtagctgccatccctgggagcctggaaccaggctggaacctggtgaagtcttaaagtagactcctcctatcggggtgtagaagggaatctgttaatcaaacagagcaatattagaaaggctacagaggtcaactcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagggccacattaggatgaaccttttaaaaagttatgcatttatttttatgtttccccactagctgtattataggacaatttttatatgtgatatgtatttaccttagtgtgttaaataaacactggcattccaagtgtgag

SEQ ID NO: 408323 - DNA, 184 bp, Homo sapiens
aacgtcaggctcccagttgtccaaactcccagactctttacttcaaaatacattatgtgatttttcattctgtcatattactggctgtatgtctgataaatgttgccttttcccctgtgtccactggccacaatccacaatatatttgaactaattgctatattctgcccaggaactggtgatt

SEQ ID NO: 408324 - DNA, 297 bp, Homo sapiens
gcgcccggccataactcagctctttacatcttttgttcatgagtagctgctgcattcactaagattcattcattcaaatggcagaatgcattcctcatgcgccacgtaagagagattatcaaaaacacaggcacaaaggagagagccttgaaatctttctcctggcttaaagttgatggattatctgcctggaccatatgcattctccaggaagttgttaaacaggttagttttattctctgagctatgagtcttatgttcttacatttttcctagcaccaaggaaataatctctga

SEQ ID NO: 408325 - DNA, 421 bp, Homo sapiens
taaaacacccaccagtgctcaaaggaaacaggggcggccatgggatagtcacagaaagagctgagaggagatctcgatgacatgcattgcagttgtgattgcagttaccaaaacggctctttaataaggaggcttaatgtataaatttgggagcaggggatctgcttacactcttgcattccacttctcccctggaaagccctctagagcttcagggaccacagaacaaaggccactgaccttgtgcagcctccacctgctagctttaatacagtgaaattgagaccccacatctctaatctgggactgggctgaaacatgcactgcatgagtctaagctgttgactcttaaagagccagagtgaactttcccccagtgggcagtagattccgctgcatctgcttatggatgtttactctt

SEQ ID NO: 408326 - DNA, 421 bp, Homo sapiens
tgtgtttggagagaagacctggcagagtaggtaaagcaatgggaagatgcagttagaaggatgagaaaagcactgaaaagaaaactaaggaaataccaaataatctcactctagagttttgcctgggatttgctatgtgccatgtttgattcttgatcttaaaaagataaaaataagtaatttcttgagcccaggaaatttgagaccagcctgggcaatgtggcaagaccccttttctacacaaaaacacaagaattagccaggcatggtggcacatacctgtagccgctgctactcggaggctgaggtgagaggatcgcctgagtctgggaagttgaggttacatttaggtgtaattgcattccagcctgggagacagagtgagatcctgtctcaagaaaaaaagaaaaagaaaggaaaa

SEQ ID NO: 408327 - DNA, 432 bp, Homo sapiens
ctgctacttggtggagacctttccattagggaaatgtggaacaactgagaagctgggttaagtttttaagtcatttatttgtcgactctggagcctgagtttagtggtcttgtccattttggaatgtgtcttgacagtagttcttggcagttgttctcagtggtggctgtgcatcagaatctcctcaggaacttttttttttccctcaagacagtcttgctctgtcacccaggctggagttcagtggcgcgatctcagctcactttaacctctgccttcccggtttaagcaattcttctgcctcagcctcctgagtagctggattgcaggtgtccaccaccacaccggcctaatttttgtatttttagtagagatgggtttcgccatgttggccaggctggtctcaaactcctgacctcatgaggaacttaa

SEQ ID NO: 408328 - DNA, 179 bp, Homo sapiens
ggtagcaggaggtagggtgaccacataatttgtaatccaaatggggctaagtggtcactgttaaaattatgctgggacaacagatataaactaggattatcccaggcgtgctgggttagtaaggatttagtcattactctgagtgacttggctttgggcagagctgcaacatgacctga

SEQ ID NO: 408329 - DNA, 428 bp, Homo sapiens
gtgaatgctattatgacaaaaggagcatgtagagaaaagaggaaaactacaccaaagtggtaacattttgggtgcattcagatgagggataggagttcatgagttagagaatctgagaaaaggcattataatgttaggagcattcttactttgattattcagaacttggttatactgtgcattctataattaaacaagcaccgtggttaattataccgtaagtgttggcattcgggccttatgtaggagatgtatctgattagattggtctgttagataatagcggtaggagtgtggataatggacaagaaatcaatcaagtatgtattttaacacatactacatgcatataatcagggggaaataaatgtaaaataaaatgtaaaatatatttaagttataatatctgccttcataaatcttaaggc

SEQ ID NO: 408330 - DNA, 372 bp, Homo sapiens
aaccagtaagctgaaagtgattggaaattcagagggacctcttttctccatattggatctctgttctttgttggacatctgcttaatacttctatatttgctgatcagcttacataaaagaaggttgatgtaccagcacttccaaggttattaattgtgtcacaagaaatagtctagactgagactgtggtagcttcattccaattctctgttatggaggagtgcactctgattggctcagtttgctgcaggtgttcaatcaacagcagttggatggggagtcatgttgtattcacctagctgcctgggagttctgcttaggtgggatgatttctagataaagtgagcaattctcagcccttgggctgaaag

SEQ ID NO: 408331 - DNA, 883 bp, Homo sapiens
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcattcagtactttctcatttaattgtggctgttgcgttacgctggtggcgtcggagccgagccggactggtcaggatgatcacggacgtgcagtcgccatcttcgccaacatgctgggcgtgtcgctcttctatgcttgtcgttctctatcactacagtgggccgtcaagaatcccaagaagccaggaatgaaaagtgggcgccttttccgccccaaggtttcccccgacataatcttgaggcacgaaggaggggcatcc

SEQ ID NO: 408332 - DNA, 3197 bp, Homo sapiens
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaagatactctgtgttactgataatatgtaaacataatacctattttatggacagaaaaagttaaatatttaaaacttgggtttttaaggaactgcctttctggtacagaatgagaatcttactgaaaacatggtaaaaactacattttaaattttaagggataaaaaggagtaattatttcccttttttaagattgtcatactggctttagagaaactgagaggtgttaagaatagtatggtttggcttttattatttaaaagatgtcttaccttcagtggttacttattccagagcttcttgaactgatacgagttgaatggcaaaagtcattttaaaccatttttaagctataaaagaatcagaagaggttagctttttttcctttctgaattggtgggtttggtgtgcttttatattaaaatatgaatgaataagagtgctta

SEQ ID NO: 408333 - DNA, 2638 bp, Homo sapiens
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcgagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaaga

SEQ ID NO: 408334 - DNA, 2025 bp, Homo sapiens
agatatagcttactcgcctgacttgggtctcacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaaga

SEQ ID NO: 408335 - DNA, 873 bp, Homo sapiens
  misc_feature (850)..(850): n is a, c, g, or t
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaactcccgcctatccgctntccaatggggatcctctgagagt

SEQ ID NO: 408336 - DNA, 856 bp, Homo sapiens
caagtagctgggattacaggcgtgcaccaccacgcccagctaattttgtatttttagtagagacagggtttcatcatgttggtcatcaggctggtctcgagctcctgacctcaaatgatccacccgcctcagcctcccaaagtgctgggattacaagtgtgagccaccatgctcggcctccgtatgcatttgatgaccagggttaaaattttatttcctgcccattgacctttttgtgcaggggaaatggtatggaatataatgcatggggatcagtctcctgaccttgtccttactaatacctgcactatgcagctggaatagaaccttgggatgtgagatttgagatagtaatttgaaaccagttgatgtccctttatattttaaagtaggatgttatttagagaagaagagaacataatactgtaagtacaggaatataggctgaaggtaaatactgttttataataaaatattcctgagtttcaaatagcaaccaatatgaattcagcttattttctgtaagttgttatccatttatttaaaaattggcaaccaatatttaaatgtccttaatagtagttaaattttattagttcttacagtattcatcttgcctattttattcatttaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatccca

SEQ ID NO: 408337 - DNA, 581 bp, Homo sapiens
agagtatgtctggtgtctagatctcttaaaaattttttagcatatatggaggtttttatcatgtaacctattgatacctaattgaagtggcctcttatatttaattccataatctactttttctcttagagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaaggtaatcaaggttttttttttgagagataaactaaaatattatacagattgagtatcccttatgcaaagtgcttgggaccagaagtgttttggatttagggttgttgggttttttttatattttgttttgtttttgtgtatatttgcatatattttggggatggaaccctagtctaagcatgaaatttatgtttcatatacacatagcctgaagataattttataaattttgtgcatgaaacaaaactacgaccca

SEQ ID NO: 408338 - DNA, 2755 bp, Homo sapiens
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaaga

SEQ ID NO: 408339 - DNA, 2784 bp, Homo sapiens
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaagaaaaaaaaaaaacaacaaaaaaaaaagggg

SEQ ID NO: 408340 - DNA, 2747 bp, Homo sapiens
  misc_feature (2598)..(2598): n is a, c, g, or t
  misc_feature (2602)..(2602): n is a, c, g, or t
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatatttgganattncctggttgaactgggtccagtcttcctattaaagcggaagtgggagaatttcactctgtaattttccggcgacatcggtggggaaaaaatgttgcccaaaaaaggggggctaaatccagggaacagacctttaaggaaggttaag

SEQ ID NO: 408341 - DNA, 2697 bp, Homo sapiens
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatctagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaaga

SEQ ID NO: 408342 - DNA, 1756 bp, Homo sapiens
agggtcaagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtatgtgcagatgaaggattcatggtattgatcaataaagagaaaacaagctgaaggtcctaatttattaatgaatctgtgagagtactctgaaatctttggaagtcgggatcatagctgtgttcatcttatatattaaaattttgaaagtttttgacacagtaagtactcagtggatgtttatgaggaaaagcattaaactgtatgtaataaaaatgtctatgtaataaagttcactttggggtaaaaggtataactattcaacagcataaacgtattatgggtatgttacaggaaagaaaggagagtagccatattaagaaaaacattgatgttgtattttataaatctgtttaaatatctacctttgaagcccttttatggtatcttacatgaaccaggatcataattataacccaggtacactcatgagtggaatcatgaaacatattatatctataatgtgtgtgtttgattattaaaaaattcaaataggacatttgtcaagaaaattttaagcatcataatgggtactgacagtggaaaatgcacaccaattctgtcaaacctcagcaattttggagcttcttttgggattgttta

SEQ ID NO: 408343 - DNA, 591 bp, Homo sapiens
aggttaatcctcattagtatcctcaatatactaacagaatagaggttctaagacatgaagtgatcttttcaaggtcacacatcaagtggttagaccacaaccaaaacccagatcaactgactgcaaacttggtgttcttgaagtaagactgatccgaaatattcagcagtcttgccagcttaccagtggactgaggacctgagaatcaactgagtctttgtcctgggatagttgagggagcagggagagaaagactggagtagatttgcttttagaagcatctctgctttaagaactaggccagggatggtggctcacgtccataatcccaggactttgggaggccaaggaaggaggattgcttgagctcaggagtttgagaccagcctgggcaatatagcgagacttcatttctacaaaaaaaaaaatcagctgggcatggtgacacaagcctatagtcttaactactcggaggccaagacagggggatggcttgagcccaggaggttgaggtcacagtgagctgtgattgcaccacttgtaactccagcctgggcaacagagtgagaccctatctctttagaaaaaaaa

SEQ ID NO: 408344 - DNA, 896 bp, Homo sapiens
atgacccggctgacagtcctggccctgctggctggtctgctggcgtcctcgagggccggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggttcgtcaacgtgactgtgacccccgaggaccagtgtcgccccaacaacgtgtgcaccggtgtgctcacccgccgcggtggcatctgcaatggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctg

SEQ ID NO: 408345 - DNA, 1177 bp, Homo sapiens
atgacccggctgacagtcctggccctgctggctggtctgctggcgtcctcgagggccggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggttcgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcagcctggaggtgccaggaagctccagaaagcaactgatcccaaagtccactagcagttaaccagggcagagaaagagaagagccatgcaaaggccctggggctggatcaggacttgtaggttccaggggcagcaagaggcctctgcagttctggggtggcgtgggagccaggccctgggacgccctgacacagctgctgcctgcccagggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctg

SEQ ID NO: 408346 - DNA, 817 bp, Homo sapiens
ggcagaggggaaatggggcctggcccacgggagagctgaggcccacgtttggccaggacagggtggatggaggctggggcctccgcagggaagatggacaggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggttcgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgccca

SEQ ID NO: 408347 - DNA, 623 bp, Homo sapiens
aggttacacagccagttaggggcagagatgaggattgacacccagtgacttccagtttctttctcatttcactgtactcaactaaattacatgaacaaaggcacaggcaggattaagctaccattttatattagatggtataaaaacaatcaactagcctggggtcaattgaattaagtctgtcagtctgtttctacaaaagttgcagaaggatgggcttcagtttgtctcttcaaagtgaactaatattttgatttttctggttgaaatatgctacaactcaccgaagtagctttctcagttgaaggtaagctccttaaaaaatgttcctattcttgggccgggtgtggtggcccccgcctgtaatcccagcactttgggaggccattgagggcagatagcttgagtccaggattttgagaacagcctgagcaacaatggcaaaaccccgtctctacaaaaaatggaaaaaaactagccaggcatggtgatgcacatctgtgttcccagctactcgggaggctgaggtgggaggatcttttgagtccgggaggcagaggttgcagtgagctgagatcatgccactgcactctggcccgtgtgacaaagtgagaccttgtctc

SEQ ID NO: 408348 - DNA, 372 bp, Homo sapiens
aatatacttaaaactgaaaatcaaaggatcaataaaaacaataggatatttttaagtacatgaaacagattatgcaaacacacatgaaaaatgcacacttctttttttcgggtgtggaacattaacataattagacatgaattttccttcatccaattgacagttgttcacgggattggaagaatgtggagatacagataccctcatctactctgggaaagggagtaagatatccttaagacaaatttagtaaaaactgcaagaaattaatggagcaattttacttctacatatctatttatcctacatatctatttacatgtgttgatagcagtaatgctgattacagtattgtttgaaagaaaatctcac

SEQ ID NO: 408349 - DNA, 486 bp, Homo sapiens
tgaattttaattatgaggctgaggttatgtttatctctttgataatgaaaaatcattatttccgggcagtagttcatatttcagctttcaaggctagaattacaatgcagtatgattcacctaatctatgaagtaaagataacagagagaaaacaggctcctgttgtcctggcagtatctgagagagtaacttctcagttataggagcgtctggttcctagataagacattctcttcgtgagcacttacactatgtgagacattgttctaggcacttttcatatattcttatctaacattcattgcatctcctataaagtacatggcatcattctgttctttcagaggttaaatgacttaagttcacatagctataagtagacgctgaatttgaaagcaaatttatctaatttaaaaaccaatgctatttatcactttgctgttactgtttttaaagccagaatttccaaagctttttagctgcag

SEQ ID NO: 408350 - DNA, 764 bp, Homo sapiens
cggcttagcccagagcctggcctcctctgtaagagtggaaaacctgggttccttctgccctcatcttattagtagctgtgatgggcacacactcagccaagcactgagatgttgtgaacacaaagatgtttgaggagctcaagagccgtctggacaccctggcccaggaggtggccctgctgaaggagcagcaggccctgcagacggtctgcctgaaggggaccaaggtgcacatgaaatgctttctggccttcacccagacgaagaccttccacgaggccagcgaggactgcatctcgcgcgggggcaccctgagcacccctcagactggctcggagaacgacgccctgtatgagtacctgcgccagagcgtgggcaacgaggccgagatctggctgggcctcaacgacatggcggccgagggcacctgggtggacatgaccggcgcccgcatcgcctacaagaactgggagactgagatcaccgcgcaacccgatggcggcaagaccgagaactgcgcggtcctgtcaggcgcggccaacggcaagtggttcgacaagcgctgccgcgatcagctgccctacatctgccagttcgggatcgtgtagccggcggggcgggggccgtggggggcctggaggagggcaggagccgcgggaggccgggaggagggtggggaccttgcagcccccatcctctccgtgcgcttggagcctctttttgcaaataaagttggtgcagcttcgcggagaaaaaaacacaag

SEQ ID NO: 408351 - DNA, 286 bp, Homo sapiens
ctcccttcctcagttttttcctcctttacaacctcctccaagccgaagctcaagaagcgcttttccctgcgttcagtgggtcgctctgtccgaggctcagtccgtggcatcctgcagtggcgggggaccgttgaccctccctcctccgctgggcccctggaggagggcaggagccgcgggaggccgggaggagggtggggaccttgcagcccccatcctctccgtgcgcttggagcctctttttgcaaataaagttggtgcagcttcgcggagaaaaaaacacaag

SEQ ID NO: 408352 - DNA, 782 bp, Homo sapiens
gcatggcgtccgtgacgctgagcgaggcggagaaggtgtacatcgtgcatggcgtccagttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgtctgcctgaaggggaccaaggtgcacatgaaatgctttctggccttcacccagacgaagaccttccacgaggccagcgaggactgcatctcgcgcgggggcaccctgagcacccctcagactggctcggagaacgacgccctgtatgagtacctgcgccagagcgtgggcaacgaggccgagatctggctgggcctcaacgacatggcggccgagggcacctgggtggacatgaccggcgcccgcatcgcctacaagaactgggagactgagatcaccgcgcaacccgatggcggcaagaccgagaactgcgcggtcctgtcaggcgcggccaacggcaagtggttcgacaagcgctgccgcgatcagctgccctacatctgccagttcgggatcgtgtagccggcggggcgggggccgtggggggcctggaggagggcaggagccgcgggaggccgggaggagggtggggaccttgcagcccccatcctctccgtgcgcttggagcctctttttgcaaataaagttggtgcagcttcgcggagaaaaaaacacaag

SEQ ID NO: 408353 - DNA, 840 bp, Homo sapiens
atccttctgcaggcttgtgtgtttgttttatttttttggcacgcctgcagccaagttggggagggtttcctggacagaggtcctttggctgctgccttaagacgtgcagcctgggccgtggctgctcactgcgttcggacccagacccgctgcaggcagcagcagcccccgcccgcgcagcagcatggagctctggggggcctacctcctcctctgcctcttctccctcctgacccaggtcaccaccgagccaccaacccagaagcccaagaagattgtaaatgccaagaaagatgttgtgaacacaaagatgtttgaggagctcaagagccgtctggacaccctggcccaggaggtggccctgctgaaggagcagcaggccctgcagacggtctgcctgaaggggaccaaggtgcacatgaaatgctttctggccttcacccagacgaagaccttccacgaggccagcgaggactgcatctcgcgcgggggcaccctgagcacccctcagactggctcggagaacgacgccctgtatgagtacctgcgccagagcgtgggcaacgaggccgagatctggctgggcctcaacgacatggcggccgagggcacctgggtggacatgaccggcgcccgcatcgcctacaagaactgggagactgagatcaccgcgcaacccgatggcggcaagaccgagaactgcgcggtcctgtcaggcgcggccaacggcaagtggttcgacaagcgctgccgcgatcagctgccctacaattgtcttttcggggattcgtgtttaaccgggtatttattatatctttcttcaatttttttattatttta

SEQ ID NO: 408354 - DNA, 949 bp, Homo sapiens
atccttctgcaggcttgtgtgtttgttttatttttttggcacgcctgcagccaagttggggagggtttcctggacagaggtcctttggctgctgccttaagacgtgcagcctgggccgtggctgctcactgcgttcggacccagacccgctgcaggcagcagcagcccccgcccgcgcagcagcatggagctctggggggcctacctcctcctctgcctcttctccctcctgacccaggtcaccaccgagccaccaacccagaagcccaagaagattgtaaatgccaagaaagatgttgtgaacacaaagatgtttgaggagctcaagagccgtctggacaccctggcccaggaggtggccctgctgaaggagcagcaggccctgcagacggtctgcctgaaggggaccaaggtgcacatgaaatgctttctggccttcacccagacgaagaccttccacgaggccagcgaggactgcatctcgcgcgggggcaccctgagcacccctcagactggctcggagaacgacgccctgtatgagtacctgcgccagagcgtgggcaacgaggccgagatctggctgggcctcaacgacatggcggccgagggcacctgggtggacatgaccggcgcccgcatcgcctacaagaactgggagactgagatcaccgcgcaacccgatggcggcaagaccgagaactgcgcggtcctgtcaggcgcggccaacggcaagtggttcgacaagcgctgccgcgatcagctgccctacatctgccagttcgggatcgtgtagccggcggggcgggggccgtggggggcctggaggagggcaggagccgcgggaggccgggaggagggtggggaccttgcagcccccatcctctccgtgcgcttggagcctctttttgcaaataaagttggtgcagcttcgcggagaaaaaaacacaag

SEQ ID NO: 408355 - DNA, 850 bp, Homo sapiens
atccttctgcaggcttgtgtgtttgttttatttttttggcacgcctgcagccaagttggggagggtttcctggacagaggtcctttggctgctgccttaagacgtgcagcctgggccgtggctgctcactgcgttcggacccagacccgctgcaggcagcagcagcccccgcccgcgcagcagcatggagctctggggggcctacctcctcctctgcctcttctccctcctgacccaggtcaccaccgagccaccaacccagaagcccaagaagattgtaaatgccaagaaagtctgcctgaaggggaccaaggtgcacatgaaatgctttctggccttcacccagacgaagaccttccacgaggccagcgaggactgcatctcgcgcgggggcaccctgagcacccctcagactggctcggagaacgacgccctgtatgagtacctgcgccagagcgtgggcaacgaggccgagatctggctgggcctcaacgacatggcggccgagggcacctgggtggacatgaccggcgcccgcatcgcctacaagaactgggagactgagatcaccgcgcaacccgatggcggcaagaccgagaactgcgcggtcctgtcaggcgcggccaacggcaagtggttcgacaagcgctgccgcgatcagctgccctacatctgccagttcgggatcgtgtagccggcggggcgggggccgtggggggcctggaggagggcaggagccgcgggaggccgggaggagggtggggaccttgcagcccccatcctctccgtgcgcttggagcctctttttgcaaataaagttggtgcagcttcgcggagaaaaaaacacaag

SEQ ID NO: 408356 - DNA, 747 bp, Homo sapiens
agcagggtgggagatgcctgaaattgtaggctctcagcaaatatttgttgctttctcctcccccctccccatcccctccagtttgttgaaagtgatgcagatgaagagcttctgtttaatattccgtaagtatctccttggtgcctacctcaggctaaataggctgtacccagttgcctcagatggattcattcactggtgtcaagagcacacatttgcttctagaaatgggataaattactttggtgggtttgaggaggaaagcatcatagctttcttggtgcagactggaaacagatgtatttgtagaacaataactgagaaattgaggtagatttcttagaattgtagaatgctagaggtagacaggatcttagaaattatctagtacaagttgacagatgagtaaactgaagcccatacaggggaagggtcttgcccagggtcacacaactaaacaggtattcaaactcaggtttgacaaccttctcttttgcattctggcagatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcggtgttctgtctatcatctctcttcatatttcacttcggagcagatcgc

SEQ ID NO: 408357 - DNA, 1576 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 408358 - DNA, 1584 bp, Homo sapiens
agcggcgctttttacgacgcggcaggcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatggataacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa
